United States Patent 12,508,308 (INFLUENZA mRNA VACCINES) - sequence listing, part 14

SEQ ID NO: 52714 - RNA, 1410 nt, Artificial Sequence
  neuraminidase__InfluenzaA__AFJ69994
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggagcggaccucaaucucaugccuauauaa

SEQ ID NO: 52715 - RNA, 1413 nt, Artificial Sequence
  neuraminidase__InfluenzaA__AFJ74389
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaguaugcaaccaaagaaucauuacauaugaaaauagcaccuggguaaaucaaacauaugucaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgaaaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauuuaccauugacaaguag

SEQ ID NO: 52716 - RNA, 1410 nt, Artificial Sequence
  neuraminidase__InfluenzaA__AFJ74399
augaauccaaaucaaaagauaauaacaauuggcucuguuucucucacuauugccacaauaugcuuccuuaugcaaauugccauccugguaauuacuuuaacauugcauuucaagcaauaugaaugcaacuccccuccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuuuagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaacaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52717 - RNA, 1410 nt, Artificial Sequence
  neuraminidase__InfluenzaA__AFJ74410
augaauccaaaucaaaagauaauaacaauuggcucuguuucucucacuauugccacaauaugcuuccuuaugcaaauugccauccugguaaugacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuauuuccaguuaugugugcucaggacuuguuggagacacacccagaaaaaacgacagcuccagcaguagccauugccugaauccuaauaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaacaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52718 - RNA, 1410 nt, Artificial Sequence
  neuraminidase__InfluenzaA__AFJ74451
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacuggacacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52719 - RNA, 1413 nt, Artificial Sequence
  neuraminidase__InfluenzaA__AFJ74462
augaauccaaaucaaaaaauaauaaccauuggaucaaucaguguggcaaucggaauaauuagucuaauauugcaaauaggaaauauuauuucaauaugggcuagccacucaauccaaacuggaagucaaaacuacacuggaauaugcaaccaaagaaucauuacauaugaaaauagcaccuggguaaaucaaacauauguuaacauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucugggugaagcuccgucuccauacaauucaagauuugaaucaguugcuuggucagcaagcgcaugccaugauggcuugggcuggcuaacaaucggaauuucugguccagauaauggagcaguggcuguacuaaaauacaacggcauaauaacugaaaccauaaaaaguuggaagaagcaaaucuuaagaacacaagagucugaaugugucugugugaacgguucauguuuuaccauaaugaccgauggcccgaguaauagggccgcaucguacagaaucuucaaaaucgagaaggggagaguuacuaaaucaauagaguuggaugcacccaauuaucauuacgaagaauguuccuguuacccagacaccggcacaguaaugugugugugcagggacaauuggcacgguucaaaucgaccuugggugucuuuuaaucaaaaccuugauuaucaaauaggauacaucugcagcgggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgagacugcaaacuggucuuggccagacggugcugaguugccauucaccauugacaaguag

SEQ ID NO: 52720 - RNA, 1410 nt, Artificial Sequence
  neuraminidase__InfluenzaA__AFJ74517
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguauaugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaagcugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugacaccaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggacuauagcauugucuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggauggggagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaaaugaagucugguggaccucaaacaguauuguuguguuuuguggcaccucagguacauauggaacaggcucauggccugauggggcggacaucaaccucaugccuauauaa

SEQ ID NO: 52721 - RNA, 1410 nt, Artificial Sequence
  neuraminidase__InfluenzaA__AFJ74564
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccacagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguccauauuagcacauugucaggaagugcucagcaugucgaggagugcuccuguuauccucgauauccuggugucagaugugucugcagagacaacuggaaaggcuccaauaggcccaucguagauauaaauguaaaggacuauagcauuguuuccaguuaugugugcucaggacuuguuggagacacacccagaaaaaaugacagcuucagcaguagccauugccuagauccuaacaaugaggaagguggucauggagugaaaggcugggccuuugaugauggaaaugacguguggaugggaagaacgaucagcgagacguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52722 - RNA, 1413 nt, Artificial Sequence
  neuraminidase__InfluenzaA__AFJ74639
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacaacaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccuaguaauggggccgccucguacaaaauuuucaagaucgagaaggggaagguuacuaaaucaauagaguugaaugcacccaguuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugguaaugguguuuggauagggaggaccaaaaguaacaggcuuagaaagggguuugagaugauuugggauccuaauggauggacaaauaccgacagugauuucucagugaaacaggauguuguagcaauaacugauuggucaggguacaguggaaguuucguucaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52723 - RNA, 1410 nt, Artificial Sequence
  neuraminidase__InfluenzaA__AFJ74640
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcaggauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacaaagguaauagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 52724 - RNA, 1413 nt, Artificial Sequence; identical to SEQ ID NO: 52722
  neuraminidase__InfluenzaA__AFJ74659

SEQ ID NO: 52725 - RNA, 1413 nt, Artificial Sequence
  neuraminidase__InfluenzaA__AFJ74679
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacaacaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccuaguaauggggccgccucguacaaaauuuucaagaucgagaaggggaagguuacuaaaucaauagaguugaaugcacccaguuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugauaaugguguuuggauagggaggaccaaaaguaacaggcuuagaaagggguuugagaugauuugggauccuaauggauggacaaauaccgacagugauuucucagugaaacaggauguuguagcaauaacugauuggucaggguacaguggaaguuucguucaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52726 - RNA, 1410 nt, Artificial Sequence
  neuraminidase__InfluenzaA__AFJ74680
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugauacugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagggaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauuaaggaggggaaaaucguucauacuagcacauugucaggaagugcucagcaugucgaggagugcuccuguuauccucgauauccuggugucagaugugucugcagagacaacuggaaaggcuccaauaggccuaucguagauauaaacauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcauaaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 52727 - RNA, 1410 nt, Artificial Sequence
  neuraminidase__InfluenzaA__AFJ74701
augaauccaaaucaaaagauaauaacaauuggcucuguuucucucaccauugccacaauaugcuuccuuaugcaaauugccauccugguaacuacuguaacauugcauuucaaccaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaauuuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauggcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauauuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacuaucagcgagaaguuacgcucagguuaugaaaccuucaaagucauugaaggcugguccaaaccuaacuccaaauuacagguaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52728 - RNA, 1410 nt, Artificial Sequence
  neuraminidase__InfluenzaA__AFJ74731
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuugugugacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaccgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggaaaucaaucucaugccuauauaa

SEQ ID NO: 52729 - RNA, 1413 nt, Artificial Sequence; identical to SEQ ID NO: 52722
  neuraminidase__InfluenzaA__AFJ74766

SEQ ID NO: 52730 - RNA, 1410 nt, Artificial Sequence
  neuraminidase__InfluenzaA__AFJ74767
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuugugugacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 52731 - RNA, 1410 nt, Artificial Sequence
  neuraminidase__InfluenzaA__AFJ74783
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuugugugacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacguauggaacaggcucauggccugauggggcggacaucaaucucaugccuauauaa

SEQ ID NO: 52732 - RNA, 1410 nt, Artificial Sequence; identical to SEQ ID NO: 47203
  neuraminidase__InfluenzaA__AFJ74807

SEQ ID NO: 52733 - RNA, 1410 nt, Artificial Sequence; identical to SEQ ID NO: 47203
  neuraminidase__InfluenzaA__AFJ74822

SEQ ID NO: 52734 - RNA, 1410 nt, Artificial Sequence
  neuraminidase__InfluenzaA__AFJ74834
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52735 - RNA, 1410 nt, Artificial Sequence
  neuraminidase__InfluenzaA__AFJ74845
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucgggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggcuuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucugguacauauggaacaggcucauggccugauggggcggauaucaaucucaugccuauauaa

SEQ ID NO: 52736 - RNA, 1413 nt, Artificial Sequence
  neuraminidase__InfluenzaA__AFJ75039
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaauaacacauauguuaauauuaacaacacuaguguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugaguuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaaugggggcgccucguacaaaauuuucaagaucgaaaaggggaagguuacuaaaucaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccacgucccaaagauggggagggcagcugcaauccagugacuauugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugauacugcaaacuggucuuggccagacggugcugaguugccguucaccauugacaaguag

SEQ ID NO: 52737 - RNA, 1410 nt, Artificial Sequence
  neuraminidase__InfluenzaA__AFJ75050
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgguuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacucaggagucagaaugcguuuguaucaauggaacuuguacaguaguaaugacugaugggagugcuucaggaaaagcugauacuaaaauacuauucauuguggaggggaaaaucguucauacuagcgcauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaagaggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52738 - RNA, 1410 nt, Artificial Sequence
  neuraminidase__InfluenzaA__AFJ75094
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaaaaacauaacagagauaguguaucugaccaacaccaccauagagaaggaaauaugccccaaacuagcagaauacagaaauuggucaaagccgcaaugugacauuacaggauuugcaccuuuuucuaaggacaacucgauuaggcuuucagcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauaguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagcaauuguuuggauccuaacaaugaagaagguggucauggagugaaaggcugggccuuugaugauggaaaugacguguggaugggaagaacgaucagcgagaagucacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaauugaagucuuguggaccucaaacaguauuguuguguuuuguggcaccucagguacauauggaacaggcucauggccugauggggcggacaucaauaucaugccuauauaa

SEQ ID NO: 52739 - RNA, 1413 nt, Artificial Sequence
  neuraminidase__InfluenzaA__AFJ75104
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucauuacauaugaaaacagcaccugggugaaucacacauauguuaauauuaacaacacuaauguuguugcuggaaaggacaaaacuccaguaacauuggccggcaacucaucucuuuguucuaucaguggaugggcuauacacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccgaguaauggggcagccucguacaaaauuuucaagaucgaaaaggggaagguuacuaaaucaauggaguuaaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacgacaaucuggacuaguggaagcagcauuucuuuuuguggcguuaauagugauauugcaaacuggucuuggccagacggugcugaguugccguucaccauugacaaguag

SEQ ID NO: 52740 - RNA, 1410 nt, Artificial Sequence; identical to SEQ ID NO: 46783
  neuraminidase__InfluenzaA__AFJ75114

SEQ ID NO: 52741 - RNA, 1410 nt, Artificial Sequence
  neuraminidase__InfluenzaA__AFJ75452
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacaguuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52742 - RNA, 1410 nt, Artificial Sequence
  neuraminidase__InfluenzaA__AFJ75463
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggagaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52743 - RNA, 1413 nt, Artificial Sequence
  neuraminidase__InfluenzaA__AFJ75552
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucauuacauaugaaaacagcaccugggugaaucacacauauguuaauauuaacaacacuaauguuguugcuggaaaggacaaaacuccagugacauuggccggcaacucaucucuuuguucuaucaguggaugggcuauacacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguuaaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacgacaaucuggacuaguggaagcagcauuucuuuuuguggcguuaauagugauauugcaaacuggucuuggccagacggugcugaguugccguucaccauugacaaguag

SEQ ID NO: 52744 - RNA, 1413 nt, Artificial Sequence
  neuraminidase__InfluenzaA__AFJ75574
augaacccaaaucaaaaaauaauaaccauuggaucaaucaguauagcaaucggaauaauuaguuuaauguugcaaauaggaaauauuauuucaauaugggcuagucacucaauccaaacuggaagucaaaaccacacuggaauaugcaaccaaagaaucauuacauaugaaaacagcaccugggugaaucacacauauguuaauauuaacaacacuaauguuguugcuggaaaggacaaaacuccaguuacauuggccggcaacucaucucuuuguucuaucaguggaugggcuauacacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaacggaauaauaacuggaaccauaaaaaguuggaaagggcagauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguuaaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccgaagauggagaaggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacgacaaucuggacuaguggaagcagcauuucuuuuuguggcguuaauagugauauugcaaacuggucuuggccagacggugcugaguugccguucaccauugacaaguag

SEQ ID NO: 52745 - RNA, 1410 nt, Artificial Sequence
  neuraminidase__InfluenzaA__AFJ75585
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauucgcccuuggacagggaacaacacuaaacaaugugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52746 - RNA, 1410 nt, Artificial Sequence
  neuraminidase__InfluenzaA__AFJ75596
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaauuagcagaauacagaaauuggucaaagccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccucuugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacucaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuugggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52747 - RNA, 1410 nt, Artificial Sequence
  neuraminidase__InfluenzaA__AFJ75607
augaauccaacucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaauuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugaaaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaagcugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcaaauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaaugacagcuccggcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 52748 - RNA, 1410 nt, Artificial Sequence
  neuraminidase__InfluenzaA__AFJ75633
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaagaaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52749 - RNA, 1413 nt, Artificial Sequence
  neuraminidase__InfluenzaA__AFJ75654
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52750 - RNA, 1410 nt, Artificial Sequence
  neuraminidase__InfluenzaA__AFJ75665
augaauccaaaucaaaagauaauaacaauuggcucuguuucucucacuauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauucgcccuuggacagggaacaacacuaaacaaugugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugauguguggaugggaagaacgaucagcgagaagucacgcuuaggguaugaaaccuucaaagucauugaaggcugguccaacccuaaguccaaauugcagauaaauaggcaagucauaguugacagagguaacagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52751 - RNA, 1413 nt, Artificial Sequence
  neuraminidase__InfluenzaA__AFJ75676
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucauuacauaugaaaacagcaccugggugaaucacacauauguuaauauuaacaacacuaauguuguugcuggaaaggacaaaacuccagugacauuggccggcaacucaucucuuuguucuaucaguggaugggcuauacacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguuaaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuaguggaagcagcauuucuuuuuguggcguuaauagugauauugcaaacuggucuuggccagacggugcugaguugccguucaccauugacaaguag

SEQ ID NO: 52752 - RNA, 1413 nt, Artificial Sequence
  neuraminidase__InfluenzaA__AFJ75687
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuugaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuuguuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52753 - RNA, 1410 nt, Artificial Sequence; identical to SEQ ID NO: 47242
  neuraminidase__InfluenzaA__AFJ76122

SEQ ID NO: 52754 - RNA, 1410 nt, Artificial Sequence
  neuraminidase__InfluenzaA__AFJ76134
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaauggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52755 - RNA, 1410 nt, Artificial Sequence; identical to SEQ ID NO: 47242
  neuraminidase__InfluenzaA__AFJ76146

SEQ ID NO: 52756 - RNA, 1410 nt, Artificial Sequence; identical to SEQ ID NO: 47306
  neuraminidase__InfluenzaA__AFJ76159

SEQ ID NO: 52757 - RNA, 1410 nt, Artificial Sequence; identical to SEQ ID NO: 48471
  neuraminidase__InfluenzaA__AFJ76173

SEQ ID NO: 52758 - RNA, 1410 nt, Artificial Sequence
  neuraminidase__InfluenzaA__AFJ76191
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugaugguaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaagggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52759 - RNA, 1413 nt, Artificial Sequence
  neuraminidase__InfluenzaA__AFJ76192
augaacccaaaucaaaagauaauaaccauuggaucgaucaguauagcaaucggaauaauuagucuaauggugcaaauaggaaauauuauuucaauaugggcuagucacucaauccaaacuggaauucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcaguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucauacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52760 - RNA, 1410 nt, Artificial Sequence; identical to SEQ ID NO: 47242
  neuraminidase__InfluenzaA__AFJ76206

SEQ ID NO: 52761 - RNA, 1410 nt, Artificial Sequence
  neuraminidase__InfluenzaA__AFJ76216
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauaaaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucgggaagugcucagcaugucgaggagugcuccuguuauccucgauauccuggugucagaugugucugcagagacaacuggaaaggauccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggcuuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52762 - RNA, 1410 nt, Artificial Sequence
  neuraminidase__InfluenzaA__AFJ77411
augaauccaaaucaaaagauaauaacaauuggcucuguuucucucacuauugccacaauaugcuuccuuaugcaaauugucauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuuggguaacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugccagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauugucuccaguuauguguguucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgagaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52763 - RNA, 1410 nt, Artificial Sequence
  neuraminidase__InfluenzaA__AFJ77422
augaauccaaaucaaaagauaauaacuauuggcucuguuucucucacuauugccacaauaugcuuccuuaugcaaauugccauccugguaauuacuguaacauuacauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggaaucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauucuggugucagaugugucugcagagacaacuggaaaggcuccaauaggcccaucguagauauaaaugugaaagauuauagcauuguuuccaguuuugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52764 - RNA, 1410 nt, Artificial Sequence
  neuraminidase__InfluenzaA__AFJ77433
augaauccaaaucaaaagauaauaacaauuggcucuguuucucucacuauugccacaauaugcuuccuuaugcaaauugucauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuuggguaacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauugucuccaguuauguguguucaggacuuguuggagacacacccagaaaaaccgacagcuccagcaguagcgauugccugaauccuaacaaugaggaagggggucauggagugaaaggcugggccuuugaugauggaaaugacguguggaugggaagaacgauuagcgagaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcacuucagguacauauggaacaggcucauggccugauggggcggacaucaaucucaugccuauauaa

SEQ ID NO: 52765 - RNA, 1410 nt, Artificial Sequence
  neuraminidase__InfluenzaA__AFJ77443
augaauccaaaucaaaagauaauaacaauuggcucuguuucucucacuauugccacaauaugcuuccuuaugcaaauugccauccugguaauuacuuuaacauugcauuucaagcaauaugaaugcaacuccccuccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuuuagcauuguuuccaguuaugugugcucaggacuuguuggagacacacccagaaaaaacgacagcuccagcaguagccauugccugaauccuaacaaugaggaaggggguaauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaacaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52766 - RNA, 1410 nt, Artificial Sequence
  neuraminidase__InfluenzaA__AFJ77465
augaauccaaaucaaaagauaauaacgauuggcucuguuucucucacuauugccacaauaugcuuccuuaugcaaauugccauccugguaacuacuguaacauugcauuucaagcaauaugaaugcaacccccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucagggagagcugauacuaaaauacuauucauugaggaggggaaaaucguucauauuagcccauugucaggaagugcucagcaugucgaggagugcuccuguuauccucgauauccuggugucagaugugucugcagagacaacuggaaaggcuccaauaggcccaucguagauauaaauguaaagaauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52767 - RNA, 1410 nt, Artificial Sequence
  neuraminidase__InfluenzaA__AFJ77476
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagucaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuggauccuaacaaugaggaagggggucauggaguaaaaggcugggccuuugaugauggaaaugacguguggaugggaagaacgaucagcgagaaauuccgcucagguuaugaaaccuucaaggucauugaaggcugguccaaaccuaacuccaaauugcagauaaauaggcaaaucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52768 - RNA, 1410 nt, Artificial Sequence
  neuraminidase__InfluenzaA__AFJ77487
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52769 - RNA, 1410 nt, Artificial Sequence
  neuraminidase__InfluenzaA__AFJ77498
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuauuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggagacugaagucugguggaccucaaacaguauuguuguguuuuguggcaccucagguacauauggaacaggcucauggccugauggggcggacaucaaucucaugccuauauaa

SEQ ID NO: 52770 - RNA, 1410 nt, Artificial Sequence
  neuraminidase__InfluenzaA__AFJ77509
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuucucuaaggacaauucaauucggcuuuccgcugguggggacauuugggugacaagagaaccuuaugugucaugcgauccugacaaguguuaccaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacggugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcauguugaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggaguaaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52771 - RNA, 1410 nt, Artificial Sequence
  neuraminidase__InfluenzaA__AFJ77520
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucaucugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaacguaaaggauuauagcauuguuuccaguuaugugugcucaggacuuguuggagacacacccagaaaaaacgacagcuccagcaguagccauugccuggauccuaacaaugaggaagguggucauggagugaaaggcugggccuuugaugauggaaaugacguguggaugggaagaacgaucagcgagaaauuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaauugaagucuuguggaccucaaacaguauuguuguguuuuguggcaccucagguacauauggaacaggcucauggccugauggggcggacaucaaucucaugccuauauaa

SEQ ID NO: 52772 - RNA, 1410 nt, Artificial Sequence
  neuraminidase__InfluenzaA__AFJ77531
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaguuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccuggauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaaguuugguggaccucaaacaguauuguuguguuuuguggcaccucagguacauauggaacaggcucauggccugauggggcggacaucaaucucaugccuauauaa

SEQ ID NO: 52773 - RNA, 1410 nt, Artificial Sequence
  neuraminidase__InfluenzaA__AFJ77542
augaauccaaaucaaaagauaauaacgauuggcucuguuucucucaccauuuccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaagagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacgcccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauaggucugguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52774 - RNA, 1410 nt, Artificial Sequence; identical to SEQ ID NO: 44757
  neuraminidase__InfluenzaA__AFJ77553

SEQ ID NO: 52775 - RNA, 1410 nt, Artificial Sequence
  neuraminidase__InfluenzaA__AFJ77564
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaaaugaagucugguggaccucaaacaguauuguuguguuuuguggcaccucagguacauauggaacaggcucauggccugauggggcggacaucaaccucaugccuauauaa

SEQ ID NO: 52776 - RNA, 1329 nt, Artificial Sequence
  neuraminidase__InfluenzaA__AFJ77575
augaauccaaaucaaaagauaauaacgauuggcucuguuucucucaccauugccacaauaugcuuccuuaugcaaauugccauccugguaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52777 - RNA, 1410 nt, Artificial Sequence
  neuraminidase__InfluenzaA__AFJ77597
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuauguaucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagaccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52778 - RNA, 1410 nt, Artificial Sequence
  neuraminidase__InfluenzaA__AFJ77608
augaauccaaaucaaaagauaauaacgauuggcucuguuucucucaccauugccacaauaugcuuccuuaugcaaacugccauccugguaacuacuguaacauugcauuucaagcaauaugaaugcaacucccccccaaacaaccaagugaugcugugugaaccaacaauaauagaaagaaacaugacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggaccucugggugacaagagaaccuuacgugucaugcgauccugacaaguguuaucaauuugcccuuggacagggaacaacacugaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaagguugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52779 - RNA, 1410 nt, Artificial Sequence
  neuraminidase__InfluenzaA__AFJ77619
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagaccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacaaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52780 - RNA, 1410 nt, Artificial Sequence
  neuraminidase__InfluenzaA__AFJ77630
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagaccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52781 - RNA, 1410 nt, Artificial Sequence
  neuraminidase__InfluenzaA__AFJ77641
augaauccaaaucaaaagauaauaacgauuggcucuguuucucucaccauuuccacaauaugcuuccuuaugcaaauugccauucugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacgcccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuuuucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52782 - RNA, 1410 nt, Artificial Sequence
  neuraminidase__InfluenzaA__AFJ77652
augaauccaaaucaaaagauaauaacgauuggcucuguuucucucaccauuuccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacgcccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52783 - RNA, 1410 nt, Artificial Sequence; identical to SEQ ID NO: 44563
  neuraminidase__InfluenzaA__AFJ77663

SEQ ID NO: 52784 - RNA, 1410 nt, Artificial Sequence
  neuraminidase__InfluenzaA__AFJ77674
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaaacaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52785 - RNA, 1410 nt, Artificial Sequence
  neuraminidase__InfluenzaA__AFJ77685
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuauagaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52786 - RNA, 1410 nt, Artificial Sequence
  neuraminidase__InfluenzaA__AFJ77696
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaaguguguauagcaugguccagcucaaguugucacgauggaaaagcauggcugcauguuuguguaacgggugaugaugaaaaugcaacugcuagcuucauuuacaaugggaggcuuguagauaguauagguucaugguccaaaaaaauccucaggacccaggagucggaaugcguuuguaucaauggaacuuguacaguaguaaugacugauggaagugcuucagaaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52787 - RNA, 1410 nt, Artificial Sequence; identical to SEQ ID NO: 44563
  neuraminidase__InfluenzaA__AFJ77707

SEQ ID NO: 52788 - RNA, 1410 nt, Artificial Sequence; identical to SEQ ID NO: 45410
  neuraminidase__InfluenzaA__AFJ77718

SEQ ID NO: 52789 - RNA, 1410 nt, Artificial Sequence; identical to SEQ ID NO: 45410
  neuraminidase__InfluenzaA__AFJ77729

SEQ ID NO: 52790 - RNA, 1410 nt, Artificial Sequence
  neuraminidase__InfluenzaA__AFJ77740
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguauaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauagaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 52791 - RNA, 1410 nt, Artificial Sequence
  neuraminidase__InfluenzaA__AFJ77751
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacgugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuuuuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguauuuuguggcaccucagguacauauggaacaggcucauggccugauggggcggacaucaaucucaugccuauauaa

SEQ ID NO: 52792 - RNA, 1410 nt, Artificial Sequence
  neuraminidase__InfluenzaA__AFJ77762
augaauccaaaucaaaagauaauaacaauuggcucuguaucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52793 - RNA, 1410 nt, Artificial Sequence; identical to SEQ ID NO: 47203
  neuraminidase__InfluenzaA__AFJ77773

SEQ ID NO: 52794 - RNA, 1410 nt, Artificial Sequence; identical to SEQ ID NO: 47203
  neuraminidase__InfluenzaA__AFJ77784

SEQ ID NO: 52795 - RNA, 1410 nt, Artificial Sequence; identical to SEQ ID NO: 52734
  neuraminidase__InfluenzaA__AFJ77795

SEQ ID NO: 52796 - RNA, 1410 nt, Artificial Sequence
  neuraminidase__InfluenzaA__AFJ77806
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaccggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52797 - RNA, 1410 nt, Artificial Sequence; identical to SEQ ID NO: 52734
  neuraminidase__InfluenzaA__AFJ77817

SEQ ID NO: 52798 - RNA, 1410 nt, Artificial Sequence
  neuraminidase__InfluenzaA__AFJ77828
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuacucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 52799 - RNA, 1410 nt, Artificial Sequence
  neuraminidase__InfluenzaA__AFJ77839
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucauucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52800 - RNA, 1410 nt, Artificial Sequence
  neuraminidase__InfluenzaA__AFJ77850
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcaaaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52801 - RNA, 1410 nt, Artificial Sequence
  neuraminidase__InfluenzaA__AFJ77861
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52802 - RNA, 1410 nt, Artificial Sequence
  neuraminidase__InfluenzaA__AFJ77872
augaauccaaaucaaaagauaauaacgauuggcucuguuucucucaccauuuccacaauaugcuucuucaugcaaauugccaucuugauaacuacuguaacauugcauuucaagcaauaugaguucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaaccuguacaguaguaaugacugaugggagugcuucaggaaaagcugauacuaaaauacuauucauugaggaggggaaaauuguucauacuagcacauugucaggaagugcucagcaugucgaggaguguuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52803 - RNA, 1410 nt, Artificial Sequence
  neuraminidase__InfluenzaA__AFJ77883
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaggaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52804 - RNA, 1410 nt, Artificial Sequence
  neuraminidase__InfluenzaA__AFJ77894
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcacuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugauguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggaaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52805 - RNA, 1410 nt, Artificial Sequence; identical to SEQ ID NO: 52804
  neuraminidase__InfluenzaA__AFJ77905

SEQ ID NO: 52806 - RNA, 1410 nt, Artificial Sequence
  neuraminidase__InfluenzaA__AFJ77916
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucgggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuauuguguuuuguggcaccucagguacauauggaacaggcucauggccugauggggcggacaucaaucucaugccuauauaa

SEQ ID NO: 52807 - RNA, 1410 nt, Artificial Sequence
  neuraminidase__InfluenzaA__AFJ77927
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaggugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggaguguuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaaacugcaucaauaggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52808 - RNA, 1410 nt, Artificial Sequence
  neuraminidase__InfluenzaA__AFJ77938
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaggugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggaguguuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcaaauaaauaggcaagucauaguugacagagguaauagguccgguuauucugguauuuucucuguugaaggcaaaaauugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52809 - RNA, 1410 nt, Artificial Sequence; identical to SEQ ID NO: 45753
  neuraminidase__InfluenzaA__AFJ77949

SEQ ID NO: 52810 - RNA, 1410 nt, Artificial Sequence; identical to SEQ ID NO: 45218
  neuraminidase__InfluenzaA__AFJ77960

SEQ ID NO: 52811 - RNA, 1410 nt, Artificial Sequence
  neuraminidase__InfluenzaA__AFJ77971
augaauccaaaucaaaaaauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccccgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaugaaacugaagucuuguggaccucaaacaguauuguuguguuuuguggcaccucagguacauauggaacaggcucauggccugauggggcggacaucaaucucaugccuauauaa

SEQ ID NO: 52812 - RNA, 1410 nt, Artificial Sequence
  neuraminidase__InfluenzaA__AFJ77982
augaauccaaaucaaaagauaauaacgauuggcuuuguuucucucaccauuuccacaauaugcuucuucaugcaaauugccaucuugauaacuacuguaccauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggaauuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52813 - RNA, 1410 nt, Artificial Sequence
  neuraminidase__InfluenzaA__AFJ77993
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucgaacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguggauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauaggucugguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52814 - RNA, 1410 nt, Artificial Sequence
  neuraminidase__InfluenzaA__AFJ78004
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaaaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52815 - RNA, 1410 nt, Artificial Sequence
  neuraminidase__InfluenzaA__AFJ78015
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauagaaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52816 - RNA, 1410 nt, Artificial Sequence
  neuraminidase__InfluenzaA__AFJ78026
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaaaaugccccaaacuagcagaauacagaaauuggucaaagccgcaauguaacauuacaggauuugcaccuuuuucuaaggacaauucgauuaggcuuuccgcugguggggacaucugggugacaagagaacccuaugugucaugcgauccugacaaguguuaucaauuugcccuuggacaaggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52817 - RNA, 1410 nt, Artificial Sequence; identical to SEQ ID NO: 52816
  neuraminidase__InfluenzaA__AFJ78037

SEQ ID NO: 52818 - RNA, 1410 nt, Artificial Sequence
  neuraminidase__InfluenzaA__AFJ78048
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaggaacauaacagagauaguguaccugaccaacaccaccauagagaaggaaauaugccccaaacuagcagaauacagaaauuggucaaagccacaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggaaugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52819 - RNA, 1410 nt, Artificial Sequence
  neuraminidase__InfluenzaA__AFJ78059
augaauccaaaucaaaaaauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccccgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaugaaacugaagucuuguggaccucaaacaguauuguuguguuuuguggcaccucagguacauauggaacaggcucauggccugauggggcggacaucaaucucaugccuauauaa

SEQ ID NO: 52820 - RNA, 1410 nt, Artificial Sequence
  neuraminidase__InfluenzaA__AFJ78070
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguggccauugcuuggauccuaacaaugaagaagguggucauggggugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52821 - RNA, 1410 nt, Artificial Sequence
  neuraminidase__InfluenzaA__AFJ78081
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacaacuccagcaguagccauuguuuggauccuaacaaugaagaagguggucauggagugaaaggcugggccuuugaugauggaaaugacguguggaugggaagaacgaucagcgagaagucacgcuuaggauaugaaaccuucaaggucauugaaggcugguccaacccuaauuccaaauugcagaugaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52822 - RNA, 1410 nt, Artificial Sequence; identical to SEQ ID NO: 52738
  neuraminidase__InfluenzaA__AFJ78092

SEQ ID NO: 52823 - RNA, 1410 nt, Artificial Sequence
  neuraminidase__InfluenzaA__AFJ78103
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacgguaguaaugacugaugggagugcuucaggaaaagcugauacuaaaauacuauucauugaggaggggaaaaucguucauacuagcacauuguuaggaagugcucagcaugucgaggagugcucaugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggauaugaaaccuucaaagucauugaaggcugguccaacccuaguuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52824 - RNA, 1410 nt, Artificial Sequence
  neuraminidase__InfluenzaA__AFJ78114
augaauccaaaucaaaagauaauaacgauuggcucuguuucucucaccauuuccacaauaugcuucuucaugcaaauugccaucuugauaacuacuguaacauugcauuucaagcaauaugaacucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaauuagguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggauaugaaaccuucaaagucauugaaggcugguccaacccuaauuccaaauugcagauaaauaggcaagucauaguugacagaaguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52825 - RNA, 1410 nt, Artificial Sequence
  neuraminidase__InfluenzaA__AFJ78125
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaaugugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggauaugaaaccuucaaagucauugaaggcugguccaacccuaauuccaaauugcagaugaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52826 - RNA, 1410 nt, Artificial Sequence
  neuraminidase__InfluenzaA__AFJ78136
augaauccaaaucaaaagauaauaacgauuggcucuguuucucucaccauuucaacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaauuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52827 - RNA, 1410 nt, Artificial Sequence; identical to SEQ ID NO: 52826
  neuraminidase__InfluenzaA__AFJ78147

SEQ ID NO: 52828 - RNA, 1410 nt, Artificial Sequence; identical to SEQ ID NO: 52826
  neuraminidase__InfluenzaA__AFJ78158

SEQ ID NO: 52829 - RNA, 1410 nt, Artificial Sequence
  neuraminidase__InfluenzaA__AFJ78169
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugauacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 52830 - RNA, 1410 nt, Artificial Sequence
  neuraminidase__InfluenzaA__AFJ78180
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugacacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggacuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 52831 - RNA, 1410 nt, Artificial Sequence
  neuraminidase__InfluenzaA__AFJ78191
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaaugugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52832 - RNA, 1410 nt, Artificial Sequence
  neuraminidase__InfluenzaA__AFJ78202
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaucaacaccaccauagagaaggaaauaugccccaaauuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacaggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaggugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucagucucaugccuauauaa

SEQ ID NO: 52833 - RNA, 1410 nt, Artificial Sequence
  neuraminidase__InfluenzaA__AFJ78213
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccaggaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugcuuauauaa

SEQ ID NO: 52834 - RNA, 1410 nt, Artificial Sequence; identical to SEQ ID NO: 52745
  neuraminidase__InfluenzaA__AFJ78224

SEQ ID NO: 52835 - RNA, 1410 nt, Artificial Sequence
  neuraminidase__InfluenzaA__AFJ78235
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauucgcccuuggacaggggacaacacuaaacaaugugcauucaaaugacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaagggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaacagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucggguacauauggaacaggcucauggccugauggggcggacaucaaucucaugccuauauaa

SEQ ID NO: 52836 - RNA, 1410 nt, Artificial Sequence
  neuraminidase__InfluenzaA__AFJ78246
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagcgaugcugugugaaccaacaauaauagaacgaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauucgcccuuggacagggaacaacacuaaacaaugugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacagugguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52837 - RNA, 1410 nt, Artificial Sequence
  neuraminidase__InfluenzaA__AFJ78268
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaauuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaagcugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcaaauugucaggaagugcucagcaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 52838 - RNA, 1410 nt, Artificial Sequence
  neuraminidase__InfluenzaA__AFJ78279
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaucaacaccaccauagagaaggaaauaugccccaaauuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacaggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaggugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52839 - RNA, 1410 nt, Artificial Sequence
  neuraminidase__InfluenzaA__AFJ78290
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcgcauugucgggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52840 - RNA, 1413 nt, Artificial Sequence
  neuraminidase__InfluenzaA__AFJ78312
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccgucuccauauaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguugggaaaagcgaauauuaagaacacaagagucugaaugugucugugugaacgggucauguuuuaccauaaugaccgauggcccgaguaauggggccgccucguacaaaaucuucaagaucgaaaaggggaagguuacuaaaucaauagaguugaaugcacccaauucucauuaugaggaauguuccuguuacccagacacuggcacagugauguguguaugccgggacaacuggcacgguucaaaucgaccuugggugucuuuuaaucaaaaccuggauuaucaaauaggauacaucugcagugggguguucggugacaauccgcgucccaaagauggagagggcagcuguaauccagugacugcugauggagcagacggaguaaagggguuuucauacaaauaugguaaugguguuuggauaggaaggacuaaaaguaacagacuuagaaagggguucgagaugauuugggauccuaauggauggacagauaccgacagugauuucucagugaaacaggauguuguggcaauaacugauuggucaggguacagcggaaguuucguucaacauccugaguuaacaggauuggacuguauaaggccuugcuucuggguugaguuagucagaggacggccuagagaaaauacaacaaucuggacuagugggagcagcauuucuuuuuguggcguaaauagugauacugcaaacuggucuuggccagacggugcugaguugccauucaccauugacaaguag

SEQ ID NO: 52841 - RNA, 1410 nt, Artificial Sequence; identical to SEQ ID NO: 52773
  neuraminidase__InfluenzaA__AFJ78323

SEQ ID NO: 52842 - RNA, 1413 nt, Artificial Sequence
  neuraminidase__InfluenzaA__AFJ78334
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccauacuggaauaugcaaccaaagaaucaucacauaugaaaacagcaccugggugaaucacacauaugucaauauuaacaacacuaauguuguugcuggaaaagacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggccuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacugguacagugauguguguaugcagggacaacuggcaugguucaaaccgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaaggccuugcuucuggguugaguuagucagaggacuuccuagagaaaauacaacaaucuggacuagugggagcagcauuucuuuuuguggcguaaauagugauacugcaaacuggucuuggccagacggugcugaguugccguucaccauugacaaguag

SEQ ID NO: 52843 - RNA, 1413 nt, Artificial Sequence
  neuraminidase__InfluenzaA__AFJ78345
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccauacuggaauaugcaaccaaagaaucaucacauaugaaaacagcaccugggugaaucacacauaugucaauauuaacaacacuaauguuguugcuggaaaagacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaauggaaccguuaaggacagaagucccuauagggccuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacugguacagugauguguguaugcagggacaacuggcaugguucaaaccgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaaggccuugcuucuggguugaguuagucagaggacuuccuagagaaaauacaacaaucuggacuagugggagcagcauuucuuuuuguggcguaaauagugauacugcaaacuggucuuggccagacggugcugaguugccguucaccauugacaaguag

SEQ ID NO: 52844 - RNA, 1413 nt, Artificial Sequence
  neuraminidase__InfluenzaA__AFJ78356
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccauacuggaauaugcaaccaaagaaucaucacauaugaaaacagcaccugggugaaucacacauaugucaauauuaacaacacuaauguuguuguuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccgucaaggacagaagucccuauagggccuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguauaugcagggacaacuggcaugguucaaaccgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaaggccuuguuucuggguugaguuagucagaggacugccuagagaaaauacaacaaucuggacuagugggagcagcauuuccuuuuguggcguaaauagugauacugcaaacuggucuuggccagacggugcugaguugccguucaccauugacaaguag

SEQ ID NO: 52845 - RNA, 1413 nt, Artificial Sequence
  neuraminidase__InfluenzaA__AFJ78367
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucauacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccgucuccauauaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcgaauauuaagaacacaagaaucugaaugugucugugugaacgggucauguuuuaccauaaugaccgauggcccgaguaauggggccgccucauacaaaaucuucaagaucgaaaaggggaagguuacuaaaucaauagaguugaaugcacccaauucucauuaugaggaauguuccuguuacccagacacuggcacagugauguguguaugccgggacaacuggcacgguucaaaucggccuugggugucuuuuaaucaaaaccuggauuaucaaauaggauacaucugcagugggguguucggugacaauccgcgucccaaagauggagagggcagcuguaauccagugacugcugauggagcagacggaguaaagggguuuucauacaaauaugguaaugguguuuggauaggaaggacuaaaaguaacagacuuagaaagggguucgagaugauuugggauccuaauggauggacagauaccgacagugauuucucagugaaacaggauguuguggcaauaacugauuggucaggguacagcggaaguuucguucaacauccugaguuaacaggauuggacuguauaaggccuugcuucuggguugaguuagucagaggacggccuagagaaaauacaacaaucuggacuagugggagcagcauuucuuuuuguggcguaaauggugauacugcaaacuggucuuggccagacggugcugaguugccauucaccauugacaaguag

SEQ ID NO: 52846 - RNA, 1413 nt, Artificial Sequence
  neuraminidase__InfluenzaA__AFJ78378
augaauccaaaucaaaaaguaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacauggaaugcagaaccuuuuuucuaacccaaggugcucuauuaaaugacaaacauucaaaugggaccguuaaggacagaaguccuuauagggccuuaaugagcuguccucuaggugaagcuccguccccauauaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaaacgaauauuaagaacacaagagucugaaugugucugugugaacgggucauguuuuaccauaaugaccgauggcccgaguaauggggccgccucguacaaaaucuucaagaucgaaaaggggaaaguuacuaaaucaauagaguugaaugcacccaauucucauuaugaggaauguuccuguuacccagacacuggcacagugauguguguaugcagggacaacuggcacgguucaaaucgaccuugggugucuuuuaaucaaaaccuggauuaucaaauaggauacaucugcagugggguguucggugacaauccgcgucccagagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucgcagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccauucaccauugacaaguag

SEQ ID NO: 52847 - RNA, 1413 nt, Artificial Sequence
  neuraminidase__InfluenzaA__AFJ78389
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 52848 - RNA, 1413 nt, Artificial Sequence; identical to SEQ ID NO: 52847
  neuraminidase__InfluenzaA__AFJ78400

SEQ ID NO: 52849 - RNA, 1413 nt, Artificial Sequence
  neuraminidase__InfluenzaA__AFJ78411
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagaugggaagggcagcuguaauccagugacuguugauggagcagacggaguuaagggguuuucauacaaauaugguaaugguguuuggauaggaaggacuaaaaguaacagacuuagaaagggauuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 52850 - RNA, 1413 nt, Artificial Sequence
  neuraminidase__InfluenzaA__AFJ78422
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaccacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcacgggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuacuaaaucaauagaguugaaugcacccaguuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcguccccaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaacggauggacaaauaccgacagugauuucucagugaaacaggauguuguagcaauaacugauuggucaggguacagcggaaguuucguucaacauccugaguuaacaggauuggacuguauaaggccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52851 - RNA, 1413 nt, Artificial Sequence
  neuraminidase__InfluenzaA__AFJ78433
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugaguuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuacuaaaucaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccacgucccaaagauggggagggcagcugcaauccagugacuguugauggagcagauggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugauacugcaaacuggucuuggccagacggugcugaguugccguucaccauugacaaguag

SEQ ID NO: 52852 - RNA, 1413 nt, Artificial Sequence
  neuraminidase__InfluenzaA__AFJ78444
augaacccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuacuaaaucaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugauacugcaaacuggucuuggccagacggugcugaguugccguucaccauugacaaguag

SEQ ID NO: 52853 - RNA, 1413 nt, Artificial Sequence
  neuraminidase__InfluenzaA__AFJ78466
augaacccaaaucaaaagauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaauucgaaucaguugcauggucagcaagcgcaugccaugauggcauaggcugguuaacaaucggaauuucugguccagacaauggagcuguggcuguacuaaaauacaacggaauaauaacuggaaccauaaaaaguuggaaaaagcaaauauuaagaacacaagagucugaaugugucuguauaaacgggucauguuucaccauaaugaccgauggcccgaguaauggggccgccucguacaaaauuuucaagaucgaaaaggggaagguuaccaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagaugcaauccagugacuguugauggagcagacggaguaaaaggguuuucauacaaauaugguaaugguguuuggauaggaaggaccaaaaguaacagacuuagaaagggguucgagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52854 - RNA, 1413 nt, Artificial Sequence
  neuraminidase__InfluenzaA__AFJ78477
augaacccaaaucaaaaaauaauaaccauuggaucaaucaguauagcaaucggaauaauuggucuaauguugcaaauaggaaauauuauuucaauaugggcuagucacucaauccaaacuggaagucaaaaccacacuggaauaugcagccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuacuaaaucaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugguacugcaaacuggucuuggccagacggugcugaguugccguucaccauugacaaguag

SEQ ID NO: 52855 - RNA, 1413 nt, Artificial Sequence
  neuraminidase__InfluenzaA__AFJ78488
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaagggguuuucauacaaauaugguaaugguguuuggauaggaagaaccaaaaguaacagacuuagaaagggguuugagaugauuugggauccuaauggauggacaaauaccgacagugauuucucaaugaaacaggauguuguagcaauaacugauuggucaggguacagcggaaguuuuguucaacauccugaguuaacaggauuggacuguauaagaccuugcuucuggguugaguuagucagagggcugccuagggaaaauacgacaaucuggacuagugggagcagcauuucuuuuuguggcguuaauagugguacugcaaacuggucuuggccagacggugcugaguugccguucaccauugacaaguag

SEQ ID NO: 52856 - RNA, 1413 nt, Artificial Sequence
  neuraminidase__InfluenzaA__AFJ78510
augaacccaaaucaaaagauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuaucuacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauggggccgccucguacaaaauuuucaagaucgaaaagggaaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccaaagauggagagggaagcugcaauccagugacuguugauggagcagacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuucuguggcguuaauagugauacugcaaacuggucuuggccagacggugcugaguugccguucaccauugacaaguag

SEQ ID NO: 52857 - RNA, 1413 nt, Artificial Sequence
  neuraminidase__InfluenzaA__AFJ78521
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucaucacauaugaaaacagcaccugggugaauaacacauauguuaauauuaacaacaccaauguuguugcugaaaaggacaaaacuucagugacauuggccggcaauucaucucuuuguucuaucagugggugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggagccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugguacugcaaacuggucuuggccagacggugcugaguugccguucaccauugacaaguag

SEQ ID NO: 52858 - RNA, 1413 nt, Artificial Sequence; identical to SEQ ID NO: 52751
  neuraminidase__InfluenzaA__AFJ78532

SEQ ID NO: 52859 - RNA, 1413 nt, Artificial Sequence; identical to SEQ ID NO: 52751
  neuraminidase__InfluenzaA__AFJ78543

SEQ ID NO: 52860 - RNA, 1413 nt, Artificial Sequence
  neuraminidase__InfluenzaA__AFJ78554
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucauuacauaugaaaacagcaccugggugaaucacacauauguuaauauuaacaacacuaauguuguugcuggaaaggacaaaacuccagugacauuggccggcaacucaucucuuuguucuaucaguggaugggcuauacacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccgaguaauggggccgccucauacaaaauuuucaagaucgaaaaggggaagguuacuaaaucaauggaguuaaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuaguggaagcagcauuucuuuuuguggcguuaauagugauauugcaaacuggucuuggccagacggugcugaguugccguucaccauugacaaguag

SEQ ID NO: 52861 - RNA, 1413 nt, Artificial Sequence; identical to SEQ ID NO: 52743
  neuraminidase__InfluenzaA__AFJ78565

SEQ ID NO: 52862 - RNA, 1413 nt, Artificial Sequence
  neuraminidase__InfluenzaA__AFJ78576
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucauuacauaugaaaacagcaccugggugaaucacacauauguuaauauuaacaacacuaauguuguugcuggaaaggacaaaacuccagugacauuggccggcaacucaucucuuuguucuaucaguggaugggcuauacacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguuaaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcacuggaguguucggugacaauccgcgucccgaagauggagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacgacaaucuggacuaguggaagcagcauuucuuuuuguggcguuaauagugauauugcaaacuggucuuggccagacggugcugaguugccguucaccauugacaaguag

SEQ ID NO: 52863 - RNA, 1413 nt, Artificial Sequence
  neuraminidase__InfluenzaA__AFJ78598
augaacccaaaucaaaagauaauaaccauuggaucaaucaguauagcaaucggaauaauuagucuaauguugcaaauaggaaauauuauuucaauaugggcuagucacucaauccaaacuggaauucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaagaaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52864 - RNA, 1413 nt, Artificial Sequence
  neuraminidase__InfluenzaA__AFJ78609
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugauauuggccggcaauucaucucuuuguuccaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucugcaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggagugaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 52865 - RNA, 1413 nt, Artificial Sequence
  neuraminidase__InfluenzaA__AFJ78620
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacucaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucugcaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 52866 - RNA, 1413 nt, Artificial Sequence
  neuraminidase__InfluenzaA__AFJ78631
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucauuacauaugaaaacagcaccugggugaaucacacauauguuaauauuaacaacacuaauguuguugcuggaaaggacaaaacuccaguuacauuggccggcaacucaucucuuuguucuaucaguggaugggcuauacacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguuaaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugguaaugguguuuggauaggaaggaccaaaaguaacagaauuagaaagggguuugaaaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacgacaaucuggacuaguggaagcagcauuucuuuuuguggcguuaauagugauauugcaaacuggucuuggccagacggugcugaguugccguucaccauugacaaguag

SEQ ID NO: 52867 - RNA, 1413 nt, Artificial Sequence
  neuraminidase__InfluenzaA__AFJ78642
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucugcaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 52868 - RNA, 1413 nt, Artificial Sequence
  neuraminidase__InfluenzaA__AFJ78653
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacucaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucugcaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugaugugugugugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 52869 - RNA, 1410 nt, Artificial Sequence; identical to SEQ ID NO: 48471
  neuraminidase__InfluenzaA__AFJ78664

SEQ ID NO: 52870 - RNA, 1410 nt, Artificial Sequence; identical to SEQ ID NO: 47242
  neuraminidase__InfluenzaA__AFJ78674

SEQ ID NO: 52871 - RNA, 1410 nt, Artificial Sequence; identical to SEQ ID NO: 47242
  neuraminidase__InfluenzaA__AFJ78684

SEQ ID NO: 52872 - RNA, 1410 nt, Artificial Sequence; identical to SEQ ID NO: 47242
  neuraminidase__InfluenzaA__AFJ78694

SEQ ID NO: 52873 - RNA, 1410 nt, Artificial Sequence; identical to SEQ ID NO: 49219
  neuraminidase__InfluenzaA__AFJ78704

SEQ ID NO: 52874 - RNA, 1410 nt, Artificial Sequence; identical to SEQ ID NO: 49492
  neuraminidase__InfluenzaA__AFJ78714

SEQ ID NO: 52875 - RNA, 1410 nt, Artificial Sequence
  neuraminidase__InfluenzaA__AFJ78724
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52876 - RNA, 1410 nt, Artificial Sequence
  neuraminidase__InfluenzaA__AFJ78734
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuauuaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggagugaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52877 - RNA, 1410 nt, Artificial Sequence; identical to SEQ ID NO: 47242
  neuraminidase__InfluenzaA__AFJ78744

SEQ ID NO: 52878 - RNA, 1410 nt, Artificial Sequence; identical to SEQ ID NO: 47242
  neuraminidase__InfluenzaA__AFJ78754

SEQ ID NO: 52879 - RNA, 1410 nt, Artificial Sequence; identical to SEQ ID NO: 47242
  neuraminidase__InfluenzaA__AFJ78764

SEQ ID NO: 52880 - RNA, 1410 nt, Artificial Sequence
  neuraminidase__InfluenzaA__AFJ78774
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaccggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52881 - RNA, 1410 nt, Artificial Sequence
  neuraminidase__InfluenzaA__AFJ78784
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcuaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52882 - RNA, 1410 nt, Artificial Sequence
  neuraminidase__InfluenzaA__AFJ78794
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuggugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52883 - RNA, 1410 nt, Artificial Sequence; identical to SEQ ID NO: 47242
  neuraminidase__InfluenzaA__AFJ78804

SEQ ID NO: 52884 - RNA, 1410 nt, Artificial Sequence; identical to SEQ ID NO: 47242
  neuraminidase__InfluenzaA__AFJ78814

SEQ ID NO: 52885 - RNA, 1410 nt, Artificial Sequence; identical to SEQ ID NO: 52758
  neuraminidase__InfluenzaA__AFJ78824

SEQ ID NO: 52886 - RNA, 1410 nt, Artificial Sequence; identical to SEQ ID NO: 48471
  neuraminidase__InfluenzaA__AFJ78834

SEQ ID NO: 52887 - RNA, 1410 nt, Artificial Sequence; identical to SEQ ID NO: 47306
  neuraminidase__InfluenzaA__AFJ78844

SEQ ID NO: 52888 - RNA, 1410 nt, Artificial Sequence
  neuraminidase__InfluenzaA__AFJ78854
augaauccaaaccaaaagauaauaaccauugguucggucuguaugacaauuggaauggcuaacuuaauauuacaaauuggaaacauaaucucaauauggauuagccacucaauucaacuugggaaucaaaaucagaucgaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucuuaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52889 - RNA, 1410 nt, Artificial Sequence
  neuraminidase__InfluenzaA__AFJ78864
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuucagugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauauaguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52890 - RNA, 1410 nt, Artificial Sequence; identical to SEQ ID NO: 47242
  neuraminidase__InfluenzaA__AFJ78874

SEQ ID NO: 52891 - RNA, 1410 nt, Artificial Sequence; identical to SEQ ID NO: 47242
  neuraminidase__InfluenzaA__AFJ78884

SEQ ID NO: 52892 - RNA, 1410 nt, Artificial Sequence; identical to SEQ ID NO: 52881
  neuraminidase__InfluenzaA__AFJ78894

SEQ ID NO: 52893 - RNA, 1410 nt, Artificial Sequence; identical to SEQ ID NO: 47242
  neuraminidase__InfluenzaA__AFJ78904

SEQ ID NO: 52894 - RNA, 1410 nt, Artificial Sequence; identical to SEQ ID NO: 47242
  neuraminidase__InfluenzaA__AFJ78914

SEQ ID NO: 52895 - RNA, 1410 nt, Artificial Sequence
  neuraminidase__InfluenzaA__AFJ78924
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguugacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaauucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52896 - RNA, 1410 nt, Artificial Sequence
  neuraminidase__InfluenzaA__AFJ97569
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaaugaaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacugugaguuggucuuggccagacggugcugaguugccauuuaccauugacaaguaa

SEQ ID NO: 52897 - RNA, 1410 nt, Artificial Sequence; identical to SEQ ID NO: 47241
  neuraminidase__InfluenzaA__AFK14107

SEQ ID NO: 52898 - RNA, 1410 nt, Artificial Sequence; identical to SEQ ID NO: 47242
  neuraminidase__InfluenzaA__AFK14117

SEQ ID NO: 52899 - RNA, 1410 nt, Artificial Sequence
  neuraminidase__InfluenzaA__AFK14141
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaagaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 52900 - RNA, 1410 nt, Artificial Sequence
  neuraminidase__InfluenzaA__AFK14150
augaauccaaaccaaaagauaauaaccauugguucggucuguaugacaauuggaauggcuaacuuaauauuacaaauuggaaacauaaucucaauauggauuagccacucaauucgacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugaugaacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52901 - RNA, 1410 nt, Artificial Sequence
  neuraminidase__InfluenzaA__AFK14159
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguguccgugaaauuagcgggcaauucuucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52902 - RNA, 1410 nt, Artificial Sequence
  neuraminidase__InfluenzaA__AFK14168
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgucaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauauaguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 52903 - RNA, 1410 nt, Artificial Sequence; identical to SEQ ID NO: 47242
  neuraminidase__InfluenzaA__AFK14177

SEQ ID NO: 52904 - RNA, 1410 nt, Artificial Sequence
  neuraminidase__InfluenzaA__AFK14186
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugagacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuuugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52905 - RNA, 1410 nt, Artificial Sequence
  neuraminidase__InfluenzaA__AFK14195
augaauccaaaccaaaagauaauaaccauugguucggucuguaugacaauuggaauggcuaacuuaauauuacaaauuggaaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52906 - RNA, 1410 nt, Artificial Sequence
  neuraminidase__InfluenzaA__AFK14204
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaauuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 52907 - RNA, 1410 nt, Artificial Sequence
  neuraminidase__InfluenzaA__AFK14213
augaauccaaaccaaaagauaauaaccauugguucggucuguaugacaauuggaauggcuaacuuaauauuacaaauuggaaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccuuaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52908 - RNA, 1410 nt, Artificial Sequence
  neuraminidase__InfluenzaA__AFK14222
augaauccaaaccaaaagauaauaaccauugguucggucuguaugacaauuggaauggcuaacuuaauauuacaaauuggaaacauaaucucaauauggauuagccacucaauucgacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52909 - RNA, 1410 nt, Artificial Sequence; identical to SEQ ID NO: 52901
  neuraminidase__InfluenzaA__AFK14231

SEQ ID NO: 52910 - RNA, 1410 nt, Artificial Sequence; identical to SEQ ID NO: 47242
  neuraminidase__InfluenzaA__AFK14240

SEQ ID NO: 52911 - RNA, 1410 nt, Artificial Sequence; identical to SEQ ID NO: 52899
  neuraminidase__InfluenzaA__AFK14249

SEQ ID NO: 52912 - RNA, 1410 nt, Artificial Sequence; identical to SEQ ID NO: 47242
  neuraminidase__InfluenzaA__AFK14257

SEQ ID NO: 52913 - RNA, 1410 nt, Artificial Sequence; identical to SEQ ID NO: 47242
  neuraminidase__InfluenzaA__AFK14266

SEQ ID NO: 52914 - RNA, 1410 nt, Artificial Sequence
  neuraminidase__InfluenzaA__AFK14274
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 52915 - RNA, 1410 nt, Artificial Sequence
  neuraminidase__InfluenzaA__AFK14281
augaauccaaaccaaaagauaauaaccauugguucggucugcaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacagauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccguaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagagcuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguuguggaccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 52916 - RNA, 1410 nt, Artificial Sequence; identical to SEQ ID NO: 47242
  neuraminidase__InfluenzaA__AFK14289

SEQ ID NO: 52917 - RNA, 1410 nt, Artificial Sequence; identical to SEQ ID NO: 52901
  neuraminidase__InfluenzaA__AFK14298

SEQ ID NO: 52918 - RNA, 1410 nt, Artificial Sequence; identical to SEQ ID NO: 50588
  neuraminidase__InfluenzaA__AFK14307

SEQ ID NO: 52919 - RNA, 1410 nt, Artificial Sequence
  neuraminidase__InfluenzaA__AFK14316
augaauccaaaccagaagauaauaaccauugguucggucuguaugacaauuggaauggcuaacuuaauauuacaaauuggaaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52920 - RNA, 1410 nt, Artificial Sequence
  neuraminidase__InfluenzaA__AFK14325
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgcacccuaaugagcuguccuauuggugaaguucccucuccauacaacucaagauuugagucaguugcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaggggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52921 - RNA, 1410 nt, Artificial Sequence; identical to SEQ ID NO: 47242
  neuraminidase__InfluenzaA__AFK14334

SEQ ID NO: 52922 - RNA, 1410 nt, Artificial Sequence; identical to SEQ ID NO: 47306
  neuraminidase__InfluenzaA__AFK14343

SEQ ID NO: 52923 - RNA, 1410 nt, Artificial Sequence
  neuraminidase__InfluenzaA__AFK14352
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguguccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 52924 - RNA, 1410 nt, Artificial Sequence; identical to SEQ ID NO: 47306
  neuraminidase__InfluenzaA__AFK14360

SEQ ID NO: 52925 - RNA, 1410 nt, Artificial Sequence
  neuraminidase__InfluenzaA__AFK14369
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguagguuggucuuggccggacggugcugaguugccauuuaccauugacaaguaa

SEQ ID NO: 52926 - RNA, 1410 nt, Artificial Sequence
  neuraminidase__InfluenzaA__AFK14387
augaauccaaaccaaaagauaauaaccauugguucggucuguaugacaauuggaauggcuaacuuaauauuacaaauuggaaacauaaccucaauauggauuagccacucaauucaacuugggaaucaaaaucagauugacacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52927 - RNA, 1410 nt, Artificial Sequence; identical to SEQ ID NO: 52901
  neuraminidase__InfluenzaA__AFK14397

SEQ ID NO: 52928 - RNA, 1410 nt, Artificial Sequence; identical to SEQ ID NO: 47242
  neuraminidase__InfluenzaA__AFK14406

SEQ ID NO: 52929 - RNA, 1410 nt, Artificial Sequence
  neuraminidase__InfluenzaA__AFK14415
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguauccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggcgaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 52930 - RNA, 1410 nt, Artificial Sequence; identical to SEQ ID NO: 49036
  neuraminidase__InfluenzaA__AFK14424

SEQ ID NO: 52931 - RNA, 1410 nt, Artificial Sequence
  neuraminidase__InfluenzaA__AFK14433
augaauccaaaccaaaagauaauaaccauugguucggucuguaugauaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52932 - RNA, 1410 nt, Artificial Sequence; identical to SEQ ID NO: 47242
  neuraminidase__InfluenzaA__AFK14442

SEQ ID NO: 52933 - RNA, 1410 nt, Artificial Sequence
  neuraminidase__InfluenzaA__AFK14451
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacaccuggguaaaucagacauauguuaacaucagcaacaccaacuuugcugcuggacagucaguggccuccgcgaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccugcuauccugauucuagugaaaucacaugugucugcagggauaacuggcauggcucgaaucgaccguggguaucuuucaaccagaaucuggaauaucagauaggauauauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccggacggugcugaguugccauuuaccauugacaaguaa

SEQ ID NO: 52934 - RNA, 1410 nt, Artificial Sequence; identical to SEQ ID NO: 47707
  neuraminidase__InfluenzaA__AFK14458

SEQ ID NO: 52935 - RNA, 1410 nt, Artificial Sequence
  neuraminidase__InfluenzaA__AFK14467
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccugcuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52936 - RNA, 1410 nt, Artificial Sequence; identical to SEQ ID NO: 47562
  neuraminidase__InfluenzaA__AFK14476

SEQ ID NO: 52937 - RNA, 1410 nt, Artificial Sequence
  neuraminidase__InfluenzaA__AFK14485
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugggccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuauugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52938 - RNA, 1410 nt, Artificial Sequence; identical to SEQ ID NO: 47707
  neuraminidase__InfluenzaA__AFK14504

SEQ ID NO: 52939 - RNA, 1410 nt, Artificial Sequence; identical to SEQ ID NO: 48264
  neuraminidase__InfluenzaA__AFK14514

SEQ ID NO: 52940 - RNA, 1410 nt, Artificial Sequence
  neuraminidase__InfluenzaA__AFK14522
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 52941 - RNA, 1410 nt, Artificial Sequence; identical to SEQ ID NO: 50657
  neuraminidase__InfluenzaA__AFK14529

SEQ ID NO: 52942 - RNA, 1410 nt, Artificial Sequence
  neuraminidase__InfluenzaA__AFK14538
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguauccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 52943 - RNA, 1410 nt, Artificial Sequence; identical to SEQ ID NO: 49617
  neuraminidase__InfluenzaA__AFK14547

SEQ ID NO: 52944 - RNA, 1410 nt, Artificial Sequence
  neuraminidase__InfluenzaA__AFK14555
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugauuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52945 - RNA, 1410 nt, Artificial Sequence
  neuraminidase__InfluenzaA__AFK14564
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuuuuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52946 - RNA, 1410 nt, Artificial Sequence; identical to SEQ ID NO: 47242
  neuraminidase__InfluenzaA__AFK14573

SEQ ID NO: 52947 - RNA, 1410 nt, Artificial Sequence
  neuraminidase__InfluenzaA__AFK14579
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacaugugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52948 - RNA, 1410 nt, Artificial Sequence; identical to SEQ ID NO: 47242
  neuraminidase__InfluenzaA__AFK14588

SEQ ID NO: 52949 - RNA, 1410 nt, Artificial Sequence; identical to SEQ ID NO: 47242
  neuraminidase__InfluenzaA__AFK14597

SEQ ID NO: 52950 - RNA, 1410 nt, Artificial Sequence; identical to SEQ ID NO: 47242
  neuraminidase__InfluenzaA__AFK14604

SEQ ID NO: 52951 - RNA, 1410 nt, Artificial Sequence
  neuraminidase__InfluenzaA__AFK14632
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagauaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagcgauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52952 - RNA, 1410 nt, Artificial Sequence; identical to SEQ ID NO: 47241
  neuraminidase__InfluenzaA__AFK14641

SEQ ID NO: 52953 - RNA, 1410 nt, Artificial Sequence; identical to SEQ ID NO: 47242
  neuraminidase__InfluenzaA__AFK14651

SEQ ID NO: 52954 - RNA, 1410 nt, Artificial Sequence; identical to SEQ ID NO: 47242
  neuraminidase__InfluenzaA__AFK14656

SEQ ID NO: 52955 - RNA, 1410 nt, Artificial Sequence; identical to SEQ ID NO: 47242
  neuraminidase__InfluenzaA__AFK14663

SEQ ID NO: 52956 - RNA, 1410 nt, Artificial Sequence; identical to SEQ ID NO: 47242
  neuraminidase__InfluenzaA__AFK14672

SEQ ID NO: 52957 - RNA, 1410 nt, Artificial Sequence; identical to SEQ ID NO: 47242
  neuraminidase__InfluenzaA__AFK14680

SEQ ID NO: 52958 - RNA, 1410 nt, Artificial Sequence; identical to SEQ ID NO: 47242
  neuraminidase__InfluenzaA__AFK14690

SEQ ID NO: 52959 - RNA, 1410 nt, Artificial Sequence
  neuraminidase__InfluenzaA__AFK14707
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagauaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52960 - RNA, 1410 nt, Artificial Sequence; identical to SEQ ID NO: 47242
  neuraminidase__InfluenzaA__AFK14715

SEQ ID NO: 52961 - RNA, 1410 nt, Artificial Sequence; identical to SEQ ID NO: 47242
  neuraminidase__InfluenzaA__AFK14724

SEQ ID NO: 52962 - RNA, 1410 nt, Artificial Sequence; identical to SEQ ID NO: 47242
  neuraminidase__InfluenzaA__AFK14733

SEQ ID NO: 52963 - RNA, 1410 nt, Artificial Sequence
  neuraminidase__InfluenzaA__AFK14751
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52964 - RNA, 1410 nt, Artificial Sequence; identical to SEQ ID NO: 47242
  neuraminidase__InfluenzaA__AFK14757

SEQ ID NO: 52965 - RNA, 1410 nt, Artificial Sequence; identical to SEQ ID NO: 52963
  neuraminidase__InfluenzaA__AFK14766

SEQ ID NO: 52966 - RNA, 1410 nt, Artificial Sequence
  neuraminidase__InfluenzaA__AFK14774
augaauccaaaccaaaagauaauaaccauugguucggucuguaugacaauuggaauggccaacuugauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52967 - RNA, 1410 nt, Artificial Sequence; identical to SEQ ID NO: 52944
  neuraminidase__InfluenzaA__AFK14781

SEQ ID NO: 52968 - RNA, 1410 nt, Artificial Sequence; identical to SEQ ID NO: 52966
  neuraminidase__InfluenzaA__AFK14790

SEQ ID NO: 52969 - RNA, 1410 nt, Artificial Sequence
  neuraminidase__InfluenzaA__AFK14800
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccagagagaacacaaucuggacuagcgggagcagcauauccuuuugugguguaaacagugacacuguggguuggucuuggccagacggugcugaguugccauuuaccauugacaaguaa

SEQ ID NO: 52970 - RNA, 1410 nt, Artificial Sequence; identical to SEQ ID NO: 52905
  neuraminidase__InfluenzaA__AFK14809

SEQ ID NO: 52971 - RNA, 1410 nt, Artificial Sequence
  neuraminidase__InfluenzaA__AFK14816
augaauccaaaccaaaagauaauaaccauugguucggucuguaugacaauuggaauggcuaacuuaauauuacaaauugggaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugggccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52972 - RNA, 1410 nt, Artificial Sequence; identical to SEQ ID NO: 47562
  neuraminidase__InfluenzaA__AFK14824

SEQ ID NO: 52973 - RNA, 1410 nt, Artificial Sequence; identical to SEQ ID NO: 47242
  neuraminidase__InfluenzaA__AFK14841

SEQ ID NO: 52974 - RNA, 1410 nt, Artificial Sequence
  neuraminidase__InfluenzaA__AFK14849
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggauaaaucaaacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52975 - RNA, 1410 nt, Artificial Sequence
  neuraminidase__InfluenzaA__AFK14856
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuauugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52976 - RNA, 1410 nt, Artificial Sequence; identical to SEQ ID NO: 47242
  neuraminidase__InfluenzaA__AFK14870

SEQ ID NO: 52977 - RNA, 1410 nt, Artificial Sequence; identical to SEQ ID NO: 47242
  neuraminidase__InfluenzaA__AFK14879

SEQ ID NO: 52978 - RNA, 1410 nt, Artificial Sequence; identical to SEQ ID NO: 47242
  neuraminidase__InfluenzaA__AFK14885

SEQ ID NO: 52979 - RNA, 1410 nt, Artificial Sequence; identical to SEQ ID NO: 47242
  neuraminidase__InfluenzaA__AFK14894

SEQ ID NO: 52980 - RNA, 1410 nt, Artificial Sequence; identical to SEQ ID NO: 47242
  neuraminidase__InfluenzaA__AFK14903

SEQ ID NO: 52981 - RNA, 1410 nt, Artificial Sequence; identical to SEQ ID NO: 47242
  neuraminidase__InfluenzaA__AFK14912

SEQ ID NO: 52982 - RNA, 1410 nt, Artificial Sequence; identical to SEQ ID NO: 47242
  neuraminidase__InfluenzaA__AFK14921

SEQ ID NO: 52983 - RNA, 1410 nt, Artificial Sequence; identical to SEQ ID NO: 47242
  neuraminidase__InfluenzaA__AFK14931

SEQ ID NO: 52984 - RNA, 1410 nt, Artificial Sequence
  neuraminidase__InfluenzaA__AFK25604
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 52985 - RNA, 1410 nt, Artificial Sequence
  neuraminidase__InfluenzaA__AFK25606
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucaucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 52986 - RNA, 1410 nt, Artificial Sequence
  neuraminidase__InfluenzaA__AFK74537
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52987 - RNA, 1410 nt, Artificial Sequence; identical to SEQ ID NO: 47242
  neuraminidase__InfluenzaA__AFK74547

SEQ ID NO: 52988 - RNA, 1410 nt, Artificial Sequence; identical to SEQ ID NO: 52374
  neuraminidase__InfluenzaA__AFK74557

SEQ ID NO: 52989 - RNA, 1410 nt, Artificial Sequence; identical to SEQ ID NO: 47242
  neuraminidase__InfluenzaA__AFK74567

SEQ ID NO: 52990 - RNA, 1410 nt, Artificial Sequence; identical to SEQ ID NO: 47242
  neuraminidase__InfluenzaA__AFK74578

SEQ ID NO: 52991 - RNA, 1410 nt, Artificial Sequence; identical to SEQ ID NO: 52357
  neuraminidase__InfluenzaA__AFK74588

SEQ ID NO: 52992 - RNA, 1410 nt, Artificial Sequence; identical to SEQ ID NO: 52358
  neuraminidase__InfluenzaA__AFK74598

SEQ ID NO: 52993 - RNA, 1410 nt, Artificial Sequence; identical to SEQ ID NO: 47242
  neuraminidase__InfluenzaA__AFK74608

SEQ ID NO: 52994 - RNA, 1410 nt, Artificial Sequence; identical to SEQ ID NO: 52361
  neuraminidase__InfluenzaA__AFK74618

SEQ ID NO: 52995 - RNA, 1410 nt, Artificial Sequence; identical to SEQ ID NO: 52361
  neuraminidase__InfluenzaA__AFK74628

SEQ ID NO: 52996 - RNA, 1410 nt, Artificial Sequence; identical to SEQ ID NO: 48505
  neuraminidase__InfluenzaA__AFK74638

SEQ ID NO: 52997 - RNA, 1410 nt, Artificial Sequence; identical to SEQ ID NO: 48505
  neuraminidase__InfluenzaA__AFK74648

SEQ ID NO: 52998 - RNA, 1410 nt, Artificial Sequence; identical to SEQ ID NO: 52366
  neuraminidase__InfluenzaA__AFK74658

SEQ ID NO: 52999 - RNA, 1410 nt, Artificial Sequence; identical to SEQ ID NO: 52366
  neuraminidase__InfluenzaA__AFK74668

SEQ ID NO: 53000 - RNA, 1410 nt, Artificial Sequence; identical to SEQ ID NO: 47242
  neuraminidase__InfluenzaA__AFK74678

SEQ ID NO: 53001 - RNA, 1410 nt, Artificial Sequence; identical to SEQ ID NO: 47242
  neuraminidase__InfluenzaA__AFK74688

SEQ ID NO: 53002 - RNA, 1410 nt, Artificial Sequence; identical to SEQ ID NO: 47242
  neuraminidase__InfluenzaA__AFK74698

SEQ ID NO: 53003 - RNA, 1410 nt, Artificial Sequence; identical to SEQ ID NO: 52373
  neuraminidase__InfluenzaA__AFK74708

SEQ ID NO: 53004 - RNA, 1410 nt, Artificial Sequence; identical to SEQ ID NO: 52374
  neuraminidase__InfluenzaA__AFK74718

SEQ ID NO: 53005 - RNA, 1410 nt, Artificial Sequence; identical to SEQ ID NO: 47242
  neuraminidase__InfluenzaA__AFK74728

SEQ ID NO: 53006 - RNA, 1410 nt, Artificial Sequence; identical to SEQ ID NO: 47242
  neuraminidase__InfluenzaA__AFK74738

SEQ ID NO: 53007 - RNA, 1410 nt, Artificial Sequence; identical to SEQ ID NO: 47242
  neuraminidase__InfluenzaA__AFK74748

SEQ ID NO: 53008 - RNA, 1410 nt, Artificial Sequence; identical to SEQ ID NO: 47242
  neuraminidase__InfluenzaA__AFK74758

SEQ ID NO: 53009 - RNA, 1410 nt, Artificial Sequence; identical to SEQ ID NO: 47242
  neuraminidase__InfluenzaA__AFK74768

SEQ ID NO: 53010 - RNA, 1410 nt, Artificial Sequence; identical to SEQ ID NO: 47242
  neuraminidase__InfluenzaA__AFK74778

SEQ ID NO: 53011 - RNA, 1410 nt, Artificial Sequence; identical to SEQ ID NO: 52374
  neuraminidase__InfluenzaA__AFK74788

SEQ ID NO: 53012 - RNA, 1410 nt, Artificial Sequence; identical to SEQ ID NO: 52374
  neuraminidase__InfluenzaA__AFK74798

SEQ ID NO: 53013 - RNA, 1410 nt, Artificial Sequence; identical to SEQ ID NO: 52374
  neuraminidase__InfluenzaA__AFK74808

SEQ ID NO: 53014 - RNA, 1410 nt, Artificial Sequence; identical to SEQ ID NO: 52374
  neuraminidase__InfluenzaA__AFK74818

SEQ ID NO: 53015 - RNA, 1410 nt, Artificial Sequence; identical to SEQ ID NO: 47242
  neuraminidase__InfluenzaA__AFK74828

SEQ ID NO: 53016 - RNA, 1410 nt, Artificial Sequence; identical to SEQ ID NO: 49198
  neuraminidase__InfluenzaA__AFK74838

SEQ ID NO: 53017 - RNA, 1410 nt, Artificial Sequence; identical to SEQ ID NO: 47242
  neuraminidase__InfluenzaA__AFK74848

SEQ ID NO: 53018 - RNA, 1410 nt, Artificial Sequence; identical to SEQ ID NO: 47242
  neuraminidase__InfluenzaA__AFK74898

SEQ ID NO: 53019 - RNA, 1410 nt, Artificial Sequence; identical to SEQ ID NO: 47242
  neuraminidase__InfluenzaA__AFK74908

SEQ ID NO: 53020 - RNA, 1410 nt, Artificial Sequence; identical to SEQ ID NO: 47242
  neuraminidase__InfluenzaA__AFK74918

SEQ ID NO: 53021 - RNA, 1410 nt, Artificial Sequence; identical to SEQ ID NO: 47242
  neuraminidase__InfluenzaA__AFK74928

SEQ ID NO: 53022 - RNA, 1410 nt, Artificial Sequence
  neuraminidase__InfluenzaA__AFK74938
augaauccaaaccaaaagauaauaaccauugguucggucuguaugacaauuggaauggcuaacuuaauauuacaaauuggaaacauaaucucaauauggauuagccauucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaauacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53023 - RNA, 1410 nt, Artificial Sequence; identical to SEQ ID NO: 47242
  neuraminidase__InfluenzaA__AFK74948

SEQ ID NO: 53024 - RNA, 1410 nt, Artificial Sequence; identical to SEQ ID NO: 49198
  neuraminidase__InfluenzaA__AFK74958

SEQ ID NO: 53025 - RNA, 1410 nt, Artificial Sequence; identical to SEQ ID NO: 52374
  neuraminidase__InfluenzaA__AFK74968

SEQ ID NO: 53026 - RNA, 1410 nt, Artificial Sequence; identical to SEQ ID NO: 52400
  neuraminidase__InfluenzaA__AFK74978

SEQ ID NO: 53027 - RNA, 1410 nt, Artificial Sequence; identical to SEQ ID NO: 52401
  neuraminidase__InfluenzaA__AFK74988

SEQ ID NO: 53028 - RNA, 1410 nt, Artificial Sequence; identical to SEQ ID NO: 47242
  neuraminidase__InfluenzaA__AFK74998

SEQ ID NO: 53029 - RNA, 1410 nt, Artificial Sequence; identical to SEQ ID NO: 52404
  neuraminidase__InfluenzaA__AFK75008

SEQ ID NO: 53030 - RNA, 1410 nt, Artificial Sequence; identical to SEQ ID NO: 47242
  neuraminidase__InfluenzaA__AFK75018

SEQ ID NO: 53031 - RNA, 1410 nt, Artificial Sequence; identical to SEQ ID NO: 47242
  neuraminidase__InfluenzaA__AFK75028

SEQ ID NO: 53032 - RNA, 1410 nt, Artificial Sequence; identical to SEQ ID NO: 47242
  neuraminidase__InfluenzaA__AFK75038

SEQ ID NO: 53033 - RNA, 1410 nt, Artificial Sequence; identical to SEQ ID NO: 47242
  neuraminidase__InfluenzaA__AFK75048

SEQ ID NO: 53034 - RNA, 1410 nt, Artificial Sequence; identical to SEQ ID NO: 47242
  neuraminidase__InfluenzaA__AFK75058

SEQ ID NO: 53035 - RNA, 1410 nt, Artificial Sequence; identical to SEQ ID NO: 52374
  neuraminidase__InfluenzaA__AFK75068

SEQ ID NO: 53036 - RNA, 1410 nt, Artificial Sequence; identical to SEQ ID NO: 52412
  neuraminidase__InfluenzaA__AFK75078

SEQ ID NO: 53037 - RNA, 1410 nt, Artificial Sequence; identical to SEQ ID NO: 47242
  neuraminidase__InfluenzaA__AFK75088

SEQ ID NO: 53038 - RNA, 1410 nt, Artificial Sequence; identical to SEQ ID NO: 47242
  neuraminidase__InfluenzaA__AFK75098

SEQ ID NO: 53039 - RNA, 1410 nt, Artificial Sequence; identical to SEQ ID NO: 52355
  neuraminidase__InfluenzaA__AFK75108

SEQ ID NO: 53040 - RNA, 1410 nt, Artificial Sequence
  neuraminidase__InfluenzaA__AFK77860
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaaaaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucggucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53041 - RNA, 1410 nt, Artificial Sequence; identical to SEQ ID NO: 48286
  neuraminidase__InfluenzaA__AFK77870

SEQ ID NO: 53042 - RNA, 1410 nt, Artificial Sequence; identical to SEQ ID NO: 48803
  neuraminidase__InfluenzaA__AFK77880

SEQ ID NO: 53043 - RNA, 1410 nt, Artificial Sequence
  neuraminidase__InfluenzaA__AFK77890
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccugcuaaaugacaaacauuccaauggaaccauuaaagacaggagcccauaucgaacccuaaugagcuguccuauuggugaaguucccucuccguacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaggcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53044 - RNA, 1410 nt, Artificial Sequence
  neuraminidase__InfluenzaA__AFK77900
augaauccaaaccaaaagauaauaaccauugguucggucuguaugacaauuggaauggcuaacuuaauauuacaaauuggaaacauaaucucaauauggauuagccacucaauucaaauugggaaucaaaaucagauugaaacaugcaaucaaagcgucauuacuuaugaaaacaacacuuggguaaaucagacauauguuaacaucagcaacaccaacuuugcugcuggacagucaguggcuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgagcccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaauacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaaugaaugaguggucaggauauagcgggaguuuuguucagcacccagaacuaacaggacuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53045 - RNA, 1410 nt, Artificial Sequence
  neuraminidase__InfluenzaA__AFK78031
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggcuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgagcccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaacccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaaugaaugaguggucaggauauagcgggaguuuuguucagcauccagaacuaacaggacuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53046 - RNA, 1410 nt, Artificial Sequence; identical to SEQ ID NO: 48286
  neuraminidase__InfluenzaA__AFK78190

SEQ ID NO: 53047 - RNA, 1362 nt, Artificial Sequence
  neuraminidase__InfluenzaA__AFM68957
augaauccaaaccagaaaauaauaaccauuggaucaaucuguaugguagucggaauaaucagccuaauauugcaaauagggaauauaaucucaauauggauuagccauucaauucaaaccggaaaucaaaaccauacuggaauaugcaaccaaggcaucauuacccauaacguuguugcugggcaggacucaacuucagugauauuaaccggcaauucaucucuuugucccauccgugggugggcuauacacagcaaagacaauggcauaagaauugguuccaaaggagacguuuuugucauaagagagccuuuuauuucauguucucacuuggaaugcaggaccuuuuuucugacucaaggcgccuuacugaaugacaagcauucauaugggaccucuaaggacagaagcccuuauagggccuuaaugagcugcccugucggugaagcuccguccccguacaauucaagguuugaaucgguugcuuggucagcaagugcaugucaugauggcaugggcuggcuaacaaucggaauuucugguccagauaauggagcaguggcuguauuaaaauacaacggcauaauaacugaaaccauaaaaaguuggaggaagaaaauauugagaacacaagagucugaauguaccuguguaaaugguucauguuuuaccauaaugaccgauggcccaagugaugggcuggccucguacaaaauuuucaagaucgagaaggggaagguuacuaaaucaauagaguugaaugcaccuaauucucacuacgaggaauguuccuguuacccugauaccggcaaagugaugugugugugcagagacaauuggcacgguucgaaccgaccauggguguccuucgaccaaaaccuagauuaucaaauaggauacaucugcagugggguuuucggugacaacccgcgucccaaagauggaacaggcagcuguggcccagugucugcugauggagcaaacggaguaaagggauuuucauauagguaugguaaugguguuuggauaggaaggacuaaaagugacaguuccagacauggguuugagaugauuugggauccuaauggauggacagagacugauaguagguucucugugagacaagauguuguggcaaugacugaucggucaggguacagcggaaguuucguucaacauccugagcuaacagggcuagacuguaugaggccuugcuucuggguugaauuaaucagaggacaaccugaggaggaaacaaucuggacuagugggagcaucauuucuuuuuguggcgugaauagugauacuguagauuggucuuggccagacggugcugaguugccguucaccauugacaaguag

SEQ ID NO: 53048 - RNA, 1410 nt, Artificial Sequence
  neuraminidase__InfluenzaA__AFM68968
augaauccaaaucaaaagauaauaacaauugguucugucucucucaccauugcaacaauaugcuuccucaugcaaauugccauccugguaacuacuguaacauugcauuucaagcaauaugagugcgacucccccgcaaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucagaaagagcugauacuaaaauacuauucauugaagaggggaaaauuguucauauuagcccauugucaggaagugcucagcauguagaggaguguuccuguuauccucgauauccuggugucagaugugucugcagagacaacuggaaaggcucuaauaggcccaucguagauauaaaugugaaagauuauagcauugcuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuaugggacaggcucauggccugauggagcggacaucaaucucaugccuauauaa

SEQ ID NO: 53049 - RNA, 1410 nt, Artificial Sequence
  neuraminidase__InfluenzaA__AFM68979
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcuggugggggcauuugggugacgagagaaccuuaugugucaugcgauccuggcaaguguuaucaauuugcacucgggcaggggaccacacuagacaacaagcauucaaaugacacaauacaugauaggaccccuuaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgaucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 53050 - RNA, 1410 nt, Artificial Sequence; identical to SEQ ID NO: 53049
  neuraminidase__InfluenzaA__AFM68990

SEQ ID NO: 53051 - RNA, 1410 nt, Artificial Sequence; identical to SEQ ID NO: 52513
  neuraminidase__InfluenzaA__AFM71723

SEQ ID NO: 53052 - RNA, 1410 nt, Artificial Sequence; identical to SEQ ID NO: 52639
  neuraminidase__InfluenzaA__AFM71734

SEQ ID NO: 53053 - RNA, 1410 nt, Artificial Sequence; identical to SEQ ID NO: 52453
  neuraminidase__InfluenzaA__AFM71745

SEQ ID NO: 53054 - RNA, 1410 nt, Artificial Sequence
  neuraminidase__InfluenzaA__AFM71771
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaaaaaauauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53055 - RNA, 1410 nt, Artificial Sequence
  neuraminidase__InfluenzaA__AFM71782
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauaguauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 53056 - RNA, 1410 nt, Artificial Sequence
  neuraminidase__InfluenzaA__AFM71794
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucauuuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauaguauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 53057 - RNA, 1410 nt, Artificial Sequence; identical to SEQ ID NO: 47962
  neuraminidase__InfluenzaA__AFM71805

SEQ ID NO: 53058 - RNA, 1410 nt, Artificial Sequence
  neuraminidase__InfluenzaA__AFM71827
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaggacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 53059 - RNA, 1410 nt, Artificial Sequence
  neuraminidase__InfluenzaA__AFM71838
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuaggugugccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggcaaagcugauacuaaaauacuauucauugaggaggggaaaaucguucauacuagcacauugucaggaagugcucagcaugucgaggaaugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53060 - RNA, 1365 nt, Artificial Sequence; identical to SEQ ID NO: 46223
  neuraminidase__InfluenzaA__AFM71849

SEQ ID NO: 53061 - RNA, 1410 nt, Artificial Sequence; identical to SEQ ID NO: 44611
  neuraminidase__InfluenzaA__AFM71860

SEQ ID NO: 53062 - RNA, 1410 nt, Artificial Sequence; identical to SEQ ID NO: 46959
  neuraminidase__InfluenzaA__AFM71871

SEQ ID NO: 53063 - RNA, 1410 nt, Artificial Sequence; identical to SEQ ID NO: 46959
  neuraminidase__InfluenzaA__AFM71882

SEQ ID NO: 53064 - RNA, 1410 nt, Artificial Sequence
  neuraminidase__InfluenzaA__AFM71893
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagaaaaagagauuugccccgaaguaguggaauacagaaauuggucaaagccgcaaugucaaauuacaggauuugcaccuuuuucuaaggacaauucaauccggcugucugcugguggggacauuugggugacgagagaaccuuaugugucaugcgacccuggcaaguguuaucaauuugcacucgggcaggggaccacacuagacaacaaacauucaaauggcacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacguaagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugaaagagggaauccaggagugaaaggcugggccuuugacaauggagaugauguauggaugggaagaacaaucaacaaagaaucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 53065 - RNA, 1410 nt, Artificial Sequence
  neuraminidase__InfluenzaA__AFM71904
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgacccuggcaaguguuaucaauuugcacucgggcaggggaccacacuagacaacaaacauucaaaugucacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguuccuggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacguaagauguaucugcagagacaacuggaaaggcucuaauaggcccguuauagacauaaauauggaagauuauagcauugauuccgguuaugugugcucagggcuuguuggcgacacacccaggaacgacgacagcucuagcaauagcaauugcagggauccuaacaaugaaagagggaauccaggagugaaaggcugggccuuugacaauggagaugauguauggaugggaagaacaaucaacaaagaaucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 53066 - RNA, 1410 nt, Artificial Sequence
  neuraminidase__InfluenzaA__AFM71915
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaaauggucaaagccgcaauguaaaauuacaggauuugcaccuuuuucuaaggacaauucaauucggcuuucugcugguggggacauuugggugacaagagaaccuuaugugucaugcgauccuggcaaguguuaucaauuugcacucgggcagggaaccacacuagacaacaaacauucaaaugacacaauacaugauagaaucccucaucgaacccuauugaugaaugaguuggguguuccauuucauuugggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagagagggaaucacggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuauguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 53067 - RNA, 1410 nt, Artificial Sequence; identical to SEQ ID NO: 45476
  neuraminidase__InfluenzaA__AFM71926

SEQ ID NO: 53068 - RNA, 1410 nt, Artificial Sequence
  neuraminidase__InfluenzaA__AFM71937
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaaauggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcagggaaccacacuagacaacaaacauucaaaugacacaauacaugauagaaucccucaucgaacccuauugaugaaugaguuggguguuccauuucauuugggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagagagggaaucacggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuauguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 53069 - RNA, 1410 nt, Artificial Sequence; identical to SEQ ID NO: 52484
  neuraminidase__InfluenzaA__AFM71948

SEQ ID NO: 53070 - RNA, 1410 nt, Artificial Sequence; identical to SEQ ID NO: 52484
  neuraminidase__InfluenzaA__AFM71959

SEQ ID NO: 53071 - RNA, 1410 nt, Artificial Sequence
  neuraminidase__InfluenzaA__AFM71970
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccguaugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaauguuaucaauuugcacucgggcaggggaccacacuagaaaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggccagucguagauauaaaugugaaagauuauagcauugauuccaguuaugugugcucagggcuuguuggcgacacacccagaaaaaacgacagaucuagcaguagcuauugccggaauccuaacaaugaaaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgcuaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 53072 - RNA, 1410 nt, Artificial Sequence; identical to SEQ ID NO: 52492
  neuraminidase__InfluenzaA__AFM71981

SEQ ID NO: 53073 - RNA, 1410 nt, Artificial Sequence
  neuraminidase__InfluenzaA__AFM71992
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucauggucccaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagaugaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53074 - RNA, 1410 nt, Artificial Sequence; identical to SEQ ID NO: 53048
  neuraminidase__InfluenzaA__AFM72013

SEQ ID NO: 53075 - RNA, 1365 nt, Artificial Sequence; identical to SEQ ID NO: 46223
  neuraminidase__InfluenzaA__AFM72024

SEQ ID NO: 53076 - RNA, 1410 nt, Artificial Sequence; identical to SEQ ID NO: 49499
  neuraminidase__InfluenzaA__AFM72035

SEQ ID NO: 53077 - RNA, 1410 nt, Artificial Sequence; identical to SEQ ID NO: 49499
  neuraminidase__InfluenzaA__AFM72046

SEQ ID NO: 53078 - RNA, 1413 nt, Artificial Sequence
  neuraminidase__InfluenzaA__AFM72057
augaauccaaaucagaaaauaauaaccauuggaucaaucuguacgacaaucggaauaauuagucuaauauugcaaauaggaaauauuauuucaauauggguuagccacucaauccaaacuggaagucaaaaccacacuggaauaugcaaccaaagaaucauuacuuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 53079 - RNA, 1413 nt, Artificial Sequence
  neuraminidase__InfluenzaA__AFM72068
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuacuuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 53080 - RNA, 1410 nt, Artificial Sequence
  neuraminidase__InfluenzaA__AFM72090
augaauccaaaucaaaagauaauaacaauuggcucuguuucucucaccauugcaacaauaugcuuccuuaugcaaauugccauccugguaacuacuguaacacugcauuucaagcaauaugagugcagcucccccccaaacaaucaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccuggcaaguguuaucaauuugcacucgggcaaggaaccacacuaaacaacaagcauucaaaugacacaguacaugauaggaccccuuaucgaacccuauugaugaaugaguugggggucccauuucauuuaggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauucucaggacccaggaaucggagugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgguauccuggugucagaugugucugcagagacaacuggaaaggcuccaauaggcccaucguagauauaaauguaaaagauuauagcauuguuuccaguuaugugugcucagggcuuguuggcgacacacccagaaaaaacgacagauccagcaguagcuauugccggaauccuaacaaugagaaagggaaucauggagugaaaggaugggccuuugacgauggaaaugacguguggaugggaagaacgauuggcgaggaguuacgcuuagguuaugaaaccuucaaagucauuggugguugguccacaccuaacuccaaauugcagauaaauaggcaagucauaguugacagcaaaaauaggucagguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 53081 - RNA, 1410 nt, Artificial Sequence
  neuraminidase__InfluenzaA__AFM72101
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaagcaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuugugguaccucagguacauauggaacaggcucauggccugauggggcggacaucaaucucaugccuauauaa

SEQ ID NO: 53082 - RNA, 1410 nt, Artificial Sequence
  neuraminidase__InfluenzaA__AFM72112
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuugugguaccucagguacauauggaacaggcucauggccugauggggcggacaucaaucucaugccuauauaa

SEQ ID NO: 53083 - RNA, 1410 nt, Artificial Sequence
  neuraminidase__InfluenzaA__AFM72123
augaauccaaaucaaaagauaauaacaauuggcucuguuucucucacuauugccacaauaugcuuucuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggagaggaguuacgcucagguuaugaaaccuucaaagucauuggagguugguccacaccuaacuccaaauugcagacaaauaggcaagucauaguugacagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuuguggcaccucagguacauauggaacaggcucauggccugauggggcggacaucaaucucaugccuauauaa

SEQ ID NO: 53084 - RNA, 1410 nt, Artificial Sequence; identical to SEQ ID NO: 52639
  neuraminidase__InfluenzaA__AFM72134

SEQ ID NO: 53085 - RNA, 1410 nt, Artificial Sequence
  neuraminidase__InfluenzaA__AFM72145
augaauccaaaucaaaagauaauaacaauuggcucuguuucucucacuauugccacaauaugcuuccuuaugcaaauugccauccuggcaauuacuguaacauugcauuucaagcaauaugagugcaacucccccccaaacaaccaaguaaugcugugugaaccaacaauaauagaaagaaacacaacagagauaguguaucugaccaacaccaccauagagaaagaaguaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguuuuuuguggcaccucagguacauauggaacaggcucauggccugauggggcggacaucaaucucaugccuauauaa

SEQ ID NO: 53086 - RNA, 1410 nt, Artificial Sequence; identical to SEQ ID NO: 47096
  neuraminidase__InfluenzaA__AFM72156

SEQ ID NO: 53087 - RNA, 1410 nt, Artificial Sequence
  neuraminidase__InfluenzaA__AFM72167
augaauccaaaucaaaagauaauaacaauuggcucuauuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccgaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 53088 - RNA, 1410 nt, Artificial Sequence
  neuraminidase__InfluenzaA__AFM72178
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccgaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 53089 - RNA, 1410 nt, Artificial Sequence
  neuraminidase__InfluenzaA__AFM72189
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugccucaggaagagcugauacuaaaauacuauucauugaggaggggaaaaucguucauauuagcccauuguuaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggagaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 53090 - RNA, 1410 nt, Artificial Sequence; identical to SEQ ID NO: 53089
  neuraminidase__InfluenzaA__AFM72200

SEQ ID NO: 53091 - RNA, 1410 nt, Artificial Sequence; identical to SEQ ID NO: 52465
  neuraminidase__InfluenzaA__AFM72211

SEQ ID NO: 53092 - RNA, 1410 nt, Artificial Sequence; identical to SEQ ID NO: 52465
  neuraminidase__InfluenzaA__AFM72222

SEQ ID NO: 53093 - RNA, 1413 nt, Artificial Sequence; identical to SEQ ID NO: 46957
  neuraminidase__InfluenzaA__AFM72233

SEQ ID NO: 53094 - RNA, 1410 nt, Artificial Sequence; identical to SEQ ID NO: 47217
  neuraminidase__InfluenzaA__AFM72249

SEQ ID NO: 53095 - RNA, 1410 nt, Artificial Sequence
  neuraminidase__InfluenzaA__AFM72260
augaauccaaaucaaaagauaauaacgauuggcucuguuucucucaccauugccacaauaugcuuccuuaugcaaauugccauccugguaacuacuguaacauugcauuucaagcaguaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugccacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 53096 - RNA, 1410 nt, Artificial Sequence; identical to SEQ ID NO: 53095
  neuraminidase__InfluenzaA__AFM72271

SEQ ID NO: 53097 - RNA, 1410 nt, Artificial Sequence
  neuraminidase__InfluenzaA__AFM72293
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaauuacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 53098 - RNA, 1410 nt, Artificial Sequence; identical to SEQ ID NO: 46958
  neuraminidase__InfluenzaA__AFM72304

SEQ ID NO: 53099 - RNA, 1410 nt, Artificial Sequence
  neuraminidase__InfluenzaA__AFM72315
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacaggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcagauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugagaaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagauaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 53100 - RNA, 1410 nt, Artificial Sequence
  neuraminidase__InfluenzaA__AFM72326
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacaggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcagauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauuucagauaaauaggcaagucauaguugacagagauaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 53101 - RNA, 1410 nt, Artificial Sequence
  neuraminidase__InfluenzaA__AFM72337
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53102 - RNA, 1410 nt, Artificial Sequence
  neuraminidase__InfluenzaA__AFM72348
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguauuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 53103 - RNA, 1410 nt, Artificial Sequence
  neuraminidase__InfluenzaA__AFM72359
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacuaaagucuuguggaccucaaacaguauuguuguguuuuguggcaccucagguacauauggaacaggcucauggccugauggggcggacaucaaucucaugccuauauaa

SEQ ID NO: 53104 - RNA, 1410 nt, Artificial Sequence; identical to SEQ ID NO: 53103
  neuraminidase__InfluenzaA__AFM72370

SEQ ID NO: 53105 - RNA, 1410 nt, Artificial Sequence; identical to SEQ ID NO: 51209
  neuraminidase__InfluenzaA__AFM72381

SEQ ID NO: 53106 - RNA, 1410 nt, Artificial Sequence
  neuraminidase__InfluenzaA__AFM72392
augaauccaaaucaaaagauaauaacgauuggcucuguuucucucaccauuuccacaauaugcuucuucaugcaaauugccaucuugauaacuacuguaacauugcauuucaagcaauaugaauucaacuccccuccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53107 - RNA, 1410 nt, Artificial Sequence
  neuraminidase__InfluenzaA__AFM72403
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugacacuaaaauacuauucauugaggaagggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 53108 - RNA, 1410 nt, Artificial Sequence; identical to SEQ ID NO: 53107
  neuraminidase__InfluenzaA__AFM72414

SEQ ID NO: 53109 - RNA, 1410 nt, Artificial Sequence
  neuraminidase__InfluenzaA__AFM72425
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaaugacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53110 - RNA, 1410 nt, Artificial Sequence; identical to SEQ ID NO: 53109
  neuraminidase__InfluenzaA__AFM72436

SEQ ID NO: 53111 - RNA, 1410 nt, Artificial Sequence; identical to SEQ ID NO: 53109
  neuraminidase__InfluenzaA__AFM72447

SEQ ID NO: 53112 - RNA, 1410 nt, Artificial Sequence; identical to SEQ ID NO: 53109
  neuraminidase__InfluenzaA__AFM72458

SEQ ID NO: 53113 - RNA, 1410 nt, Artificial Sequence; identical to SEQ ID NO: 53109
  neuraminidase__InfluenzaA__AFM72469

SEQ ID NO: 53114 - RNA, 1410 nt, Artificial Sequence
  neuraminidase__InfluenzaA__AFM72491
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugaugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauaucccggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53115 - RNA, 1410 nt, Artificial Sequence; identical to SEQ ID NO: 53114
  neuraminidase__InfluenzaA__AFM72502

SEQ ID NO: 53116 - RNA, 1413 nt, Artificial Sequence
  neuraminidase__InfluenzaA__AFM72513
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaaugcuccuguuacccagacacuggcauagugauguguguaugcagggacaacuggcaugguucaaaucgaccuugggugucuuucaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53117 - RNA, 1413 nt, Artificial Sequence; identical to SEQ ID NO: 53116
  neuraminidase__InfluenzaA__AFM72524

SEQ ID NO: 53118 - RNA, 1413 nt, Artificial Sequence; identical to SEQ ID NO: 53116
  neuraminidase__InfluenzaA__AFM72535

SEQ ID NO: 53119 - RNA, 1413 nt, Artificial Sequence; identical to SEQ ID NO: 53116
  neuraminidase__InfluenzaA__AFM72546

SEQ ID NO: 53120 - RNA, 1413 nt, Artificial Sequence; identical to SEQ ID NO: 53116
  neuraminidase__InfluenzaA__AFM72557

SEQ ID NO: 53121 - RNA, 1410 nt, Artificial Sequence
  neuraminidase__InfluenzaA__AFM72579
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcauauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53122 - RNA, 1413 nt, Artificial Sequence
  neuraminidase__InfluenzaA__AFM72802
augaacccaaaucaaaaaauaauaaccauuggaucaaucaguauagcaaucggaauaauuaguuuaauguugcaaauaggaaauauuauuucgauaugggcuagucacucaauccaaacuggaagucaaaaccacacuggaaugugcaaccaaagaaucauuacauaugaaaacagcaccugggugaaucacacauauguuaauauuaacaacaccaauguuguugcuggaaaggacaaaacuccaguuacauuggccggcaacucaucucuuuguucuaucaguggaugggcuauacacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugacugaugguccgaguaauggggccgccucguacaaaauuuucaagaucgaaaaggggaagguuauuaaaucaauggaguuaaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacgacaaucuggacuaguggaagcagcauuuccuuuuguggcguuaauagugauauugcaaacuggucuuggccagacggugcugagcugccguucaccauugacaaguag

SEQ ID NO: 53123 - RNA, 1413 nt, Artificial Sequence; identical to SEQ ID NO: 53122
  neuraminidase__InfluenzaA__AFM72813

SEQ ID NO: 53124 - RNA, 1413 nt, Artificial Sequence; identical to SEQ ID NO: 53122
  neuraminidase__InfluenzaA__AFM72824

SEQ ID NO: 53125 - RNA, 1410 nt, Artificial Sequence; identical to SEQ ID NO: 47232
  neuraminidase__InfluenzaA__AFM72835

SEQ ID NO: 53126 - RNA, 1410 nt, Artificial Sequence; identical to SEQ ID NO: 47232
  neuraminidase__InfluenzaA__AFM72845

SEQ ID NO: 53127 - RNA, 1410 nt, Artificial Sequence
  neuraminidase__InfluenzaA__AFM72855
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucaguugaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53128 - RNA, 1410 nt, Artificial Sequence; identical to SEQ ID NO: 47232
  neuraminidase__InfluenzaA__AFM72865

SEQ ID NO: 53129 - RNA, 1410 nt, Artificial Sequence
  neuraminidase__InfluenzaA__AFM72875
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauaguauugucuccaguuauguguguucaggacuuguuggagacacacccagaaaaagcgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 53130 - RNA, 1410 nt, Artificial Sequence; identical to SEQ ID NO: 47962
  neuraminidase__InfluenzaA__AFM72886

SEQ ID NO: 53131 - RNA, 1410 nt, Artificial Sequence; identical to SEQ ID NO: 47962
  neuraminidase__InfluenzaA__AFM72897

SEQ ID NO: 53132 - RNA, 1410 nt, Artificial Sequence
  neuraminidase__InfluenzaA__AFM72908
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacacaaaggaucauagcauugucuccaguuauguguguucaggacuuguuggagacacacccagaaaaaacgauagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 53133 - RNA, 1410 nt, Artificial Sequence
  neuraminidase__InfluenzaA__AFM72919
augaauccaaaucaaaagauaauaacgauuggcucuguuucucucaccauuuccacaauaugcuucuucaugcaaauugccaucuugauaacuacuguaacauugcauuucaagcaacaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacacaaaggaucauagcauugucuccaguuauguguguucaggacuuguuggagacacacccagaaaaaacgauagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 53134 - RNA, 1410 nt, Artificial Sequence; identical to SEQ ID NO: 49718
  neuraminidase__InfluenzaA__AFM72930

SEQ ID NO: 53135 - RNA, 1410 nt, Artificial Sequence
  neuraminidase__InfluenzaA__AFM72941
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggaugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53136 - RNA, 1410 nt, Artificial Sequence; identical to SEQ ID NO: 49718
  neuraminidase__InfluenzaA__AFM72952

SEQ ID NO: 53137 - RNA, 1410 nt, Artificial Sequence; identical to SEQ ID NO: 49718
  neuraminidase__InfluenzaA__AFM72963

SEQ ID NO: 53138 - RNA, 1410 nt, Artificial Sequence; identical to SEQ ID NO: 49718
  neuraminidase__InfluenzaA__AFM72974

SEQ ID NO: 53139 - RNA, 1410 nt, Artificial Sequence; identical to SEQ ID NO: 53059
  neuraminidase__InfluenzaA__AFM72985

SEQ ID NO: 53140 - RNA, 1410 nt, Artificial Sequence
  neuraminidase__InfluenzaA__AFM72996
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgacccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53141 - RNA, 1410 nt, Artificial Sequence; identical to SEQ ID NO: 53140
  neuraminidase__InfluenzaA__AFM73007

SEQ ID NO: 53142 - RNA, 1410 nt, Artificial Sequence
  neuraminidase__InfluenzaA__AFM73018
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguauuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53143 - RNA, 1410 nt, Artificial Sequence; identical to SEQ ID NO: 53142
  neuraminidase__InfluenzaA__AFM73028

SEQ ID NO: 53144 - RNA, 1410 nt, Artificial Sequence; identical to SEQ ID NO: 53142
  neuraminidase__InfluenzaA__AFM73038

SEQ ID NO: 53145 - RNA, 1410 nt, Artificial Sequence; identical to SEQ ID NO: 48977
  neuraminidase__InfluenzaA__AFM73048

SEQ ID NO: 53146 - RNA, 1410 nt, Artificial Sequence
  neuraminidase__InfluenzaA__AFM73058
augaauccaaaccaaaagauaauaaccauugguucguucuguaugacaauuggauuggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaaaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53147 - RNA, 1410 nt, Artificial Sequence; identical to SEQ ID NO: 48977
  neuraminidase__InfluenzaA__AFM73068

SEQ ID NO: 53148 - RNA, 1413 nt, Artificial Sequence; identical to SEQ ID NO: 45455
  neuraminidase__InfluenzaA__AFM73480

SEQ ID NO: 53149 - RNA, 1350 nt, Artificial Sequence
  neuraminidase__InfluenzaA__AFM78569
augaauccaaaucagaagauaauaaccauuggaucaaucuguaugguaauuggaauaguuagcuuaauguuacaaauugggaacaugaucucaauaugggucauucauucaauucagacagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguuccaagggggauguguuuguuauuagagagccguucaucucaugcucccaccuggaaugcagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacgacauacugagaacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggaaugcuccuguuauccugaugccggcgaaaucacauguguuugcagggauaauuggcauggcucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaauuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 53150 - RNA, 1410 nt, Artificial Sequence
  neuraminidase__InfluenzaA__AFM85180
augaauccaaaucaaaaaauaauaacgauuggcucuguuucucucaccauugccacaauaugcuuccuuacgcaaauugccauccugguaacuacuguaacauugcauuucaagcaauaugaaugcaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucuggguuacaagagaaccuuaugugucaugcgguccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucugaaugcguuuguaucaauggaacuuguacaguaguaaugacugaugggagugcuucaggaaaagcugauacuaaaauacuauucauugaagaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggagcugauaaggggaaggaaccaggaaacugaagucuuguggaccucaaacaguauuguuguguuuuguggcaccucggguacauauggaacaggcucauggccugauggggcggacaucaaucucaugccuauauaa

SEQ ID NO: 53151 - RNA, 1410 nt, Artificial Sequence
  neuraminidase__InfluenzaA__AFN11830
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacuagggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 53152 - RNA, 1410 nt, Artificial Sequence
  neuraminidase__InfluenzaA__AFN11831
augaauccaaaucaaaagauaauaacaauuggcucugucucucucaccauugcaacaauaugcuuccucaugcaaauugccauccugguaacuacuguaacauugcauuucaagcaauaugagugcgacucucccgcaaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagaugugucugcagagacaacuggaaaggcucuaauaggcccgucguagauauaaaugugaaagauuauagcauuguuuccaguuaugugugcucagggcuuguuggcgacacacccagaaacaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuaugggacaggcucauggccugauggggcggacaucaaucucaugccuauauaa

SEQ ID NO: 53153 - RNA, 1410 nt, Artificial Sequence; identical to SEQ ID NO: 45080
  neuraminidase__InfluenzaA__AFN11833

SEQ ID NO: 53154 - RNA, 1410 nt, Artificial Sequence; identical to SEQ ID NO: 47015
  neuraminidase__InfluenzaA__AFN11835

SEQ ID NO: 53155 - RNA, 1410 nt, Artificial Sequence
  neuraminidase__InfluenzaA__AFN11836
augaauccaaaucaaaagauaauaacaauuggcucuguuucucucaccauugccacaaugugcuuccuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccuccugaugaaugaguuggguguuccauuucacuugggaaccaagcaagugugcauagcaugguccagcucaaguugucacgauggaaaagcauggcugcauguuugugucacugggcaugauaaaaaugcaacugccagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucauucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacaaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuuguggcaccucagguacauauggaacaggcucauggccugauggggcggacaucaaucucaugccuauauaa

SEQ ID NO: 53156 - RNA, 1410 nt, Artificial Sequence
  neuraminidase__InfluenzaA__AFN11839
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaaguaaugccaugucaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagauauuugggugacaagagaaccuuaugugucaugugauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaauaugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucagcgaggaguuacgcucagguuaugaaaccuucaaagucauuggagguugguccacaccuaauuccaaauugcagauaaauaggcaagucauaguugacagcgguaauagguccgguuauucugguauuuucucuguugaaggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 53157 - RNA, 1410 nt, Artificial Sequence
  neuraminidase__InfluenzaA__AFN11840
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucggcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugguaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 53158 - RNA, 1410 nt, Artificial Sequence
  neuraminidase__InfluenzaA__AFN11841
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 53159 - RNA, 1410 nt, Artificial Sequence; identical to SEQ ID NO: 52521
  neuraminidase__InfluenzaA__AFN11842

SEQ ID NO: 53160 - RNA, 1410 nt, Artificial Sequence
  neuraminidase__InfluenzaA__AFN11844
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguauuaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucggucucaugccuauguag

SEQ ID NO: 53161 - RNA, 1410 nt, Artificial Sequence; identical to SEQ ID NO: 53080
  neuraminidase__InfluenzaA__AFN11845

SEQ ID NO: 53162 - RNA, 1410 nt, Artificial Sequence
  neuraminidase__InfluenzaA__AFN11847
augaauccaaaucaaaagauaauaacaauuggcucaguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcuagcuucauuuacgaugggaggcuuguggauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 53163 - RNA, 1410 nt, Artificial Sequence
  neuraminidase__InfluenzaA__AFN11848
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggguccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 53164 - RNA, 1410 nt, Artificial Sequence
  neuraminidase__InfluenzaA__AFN11850
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugguaggaccccuuaucggacccuauugaugaaugaguuagguguuccuuuucaucuggggaccaagcaagugugcauagcgugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaacuuucaaaguuauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53165 - RNA, 1410 nt, Artificial Sequence
  neuraminidase__InfluenzaA__AFN11851
augaauccaaaucaaaagauaauaacaauuggcucuguuucucucacuauugccacaauaugccuccuuaugcaaauugccauccugguaacuacuguaacauugcauuucaagcaauaugagugcaacucccccccaaacaaccaaguaaugcugugugaaccaacaauaauagaaagaaacauaacaaagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 53166 - RNA, 1410 nt, Artificial Sequence; identical to SEQ ID NO: 46959
  neuraminidase__InfluenzaA__AFN11853

SEQ ID NO: 53167 - RNA, 1410 nt, Artificial Sequence
  neuraminidase__InfluenzaA__AFN11855
augaauccaaaucaaaagauaauaacgauuggcucuguuucucucaccauuuccacaauaugcuucuucaugcaaacugccaucuugauaacuauuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcauauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53168 - RNA, 1410 nt, Artificial Sequence; identical to SEQ ID NO: 46958
  neuraminidase__InfluenzaA__AFN11857

SEQ ID NO: 53169 - RNA, 1410 nt, Artificial Sequence; identical to SEQ ID NO: 47242
  neuraminidase__InfluenzaA__AFN17373

SEQ ID NO: 53170 - RNA, 1410 nt, Artificial Sequence
  neuraminidase__InfluenzaA__AFN17383
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53171 - RNA, 1410 nt, Artificial Sequence; identical to SEQ ID NO: 47242
  neuraminidase__InfluenzaA__AFN17393

SEQ ID NO: 53172 - RNA, 1410 nt, Artificial Sequence; identical to SEQ ID NO: 47242
  neuraminidase__InfluenzaA__AFN17403

SEQ ID NO: 53173 - RNA, 1410 nt, Artificial Sequence; identical to SEQ ID NO: 47242
  neuraminidase__InfluenzaA__AFN17413

SEQ ID NO: 53174 - RNA, 1410 nt, Artificial Sequence; identical to SEQ ID NO: 47242
  neuraminidase__InfluenzaA__AFN17423

SEQ ID NO: 53175 - RNA, 1410 nt, Artificial Sequence; identical to SEQ ID NO: 47242
  neuraminidase__InfluenzaA__AFN17433

SEQ ID NO: 53176 - RNA, 1410 nt, Artificial Sequence; identical to SEQ ID NO: 47242
  neuraminidase__InfluenzaA__AFN17443

SEQ ID NO: 53177 - RNA, 1410 nt, Artificial Sequence; identical to SEQ ID NO: 47242
  neuraminidase__InfluenzaA__AFN17453

SEQ ID NO: 53178 - RNA, 1410 nt, Artificial Sequence; identical to SEQ ID NO: 48683
  neuraminidase__InfluenzaA__AFN17459

SEQ ID NO: 53179 - RNA, 1410 nt, Artificial Sequence; identical to SEQ ID NO: 47242
  neuraminidase__InfluenzaA__AFN17469

SEQ ID NO: 53180 - RNA, 1410 nt, Artificial Sequence; identical to SEQ ID NO: 47242
  neuraminidase__InfluenzaA__AFN17479

SEQ ID NO: 53181 - RNA, 1410 nt, Artificial Sequence; identical to SEQ ID NO: 47242
  neuraminidase__InfluenzaA__AFN17489

SEQ ID NO: 53182 - RNA, 1410 nt, Artificial Sequence; identical to SEQ ID NO: 47242
  neuraminidase__InfluenzaA__AFN17499

SEQ ID NO: 53183 - RNA, 1410 nt, Artificial Sequence; identical to SEQ ID NO: 47242
  neuraminidase__InfluenzaA__AFN17509

SEQ ID NO: 53184 - RNA, 1410 nt, Artificial Sequence; identical to SEQ ID NO: 47242
  neuraminidase__InfluenzaA__AFN17519

SEQ ID NO: 53185 - RNA, 1410 nt, Artificial Sequence; identical to SEQ ID NO: 47242
  neuraminidase__InfluenzaA__AFN17529

SEQ ID NO: 53186 - RNA, 1410 nt, Artificial Sequence; identical to SEQ ID NO: 47242
  neuraminidase__InfluenzaA__AFN17539

SEQ ID NO: 53187 - RNA, 1410 nt, Artificial Sequence
  neuraminidase__InfluenzaA__AFN17549
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucuguccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53188 - RNA, 1410 nt, Artificial Sequence; identical to SEQ ID NO: 48505
  neuraminidase__InfluenzaA__AFN17559

SEQ ID NO: 53189 - RNA, 1410 nt, Artificial Sequence; identical to SEQ ID NO: 47242
  neuraminidase__InfluenzaA__AFN17569

SEQ ID NO: 53190 - RNA, 1410 nt, Artificial Sequence; identical to SEQ ID NO: 47242
  neuraminidase__InfluenzaA__AFN17575

SEQ ID NO: 53191 - RNA, 1410 nt, Artificial Sequence; identical to SEQ ID NO: 47242
  neuraminidase__InfluenzaA__AFN17581

SEQ ID NO: 53192 - RNA, 1410 nt, Artificial Sequence; identical to SEQ ID NO: 47242
  neuraminidase__InfluenzaA__AFN17587

SEQ ID NO: 53193 - RNA, 1410 nt, Artificial Sequence; identical to SEQ ID NO: 47242
  neuraminidase__InfluenzaA__AFN17597

SEQ ID NO: 53194 - RNA, 1410 nt, Artificial Sequence
  neuraminidase__InfluenzaA__AFN17607
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53195 - RNA, 1410 nt, Artificial Sequence; identical to SEQ ID NO: 47242
  neuraminidase__InfluenzaA__AFN17617

SEQ ID NO: 53196 - RNA, 1410 nt, Artificial Sequence; identical to SEQ ID NO: 47242
  neuraminidase__InfluenzaA__AFN17627

SEQ ID NO: 53197 - RNA, 1410 nt, Artificial Sequence; identical to SEQ ID NO: 47242
  neuraminidase__InfluenzaA__AFN17637

SEQ ID NO: 53198 - RNA, 1410 nt, Artificial Sequence; identical to SEQ ID NO: 47242
  neuraminidase__InfluenzaA__AFN17647

SEQ ID NO: 53199 - RNA, 1410 nt, Artificial Sequence; identical to SEQ ID NO: 48035
  neuraminidase__InfluenzaA__AFN17657

SEQ ID NO: 53200 - RNA, 1410 nt, Artificial Sequence
  neuraminidase__InfluenzaA__AFN17667
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucggucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53201 - RNA, 1410 nt, Artificial Sequence; identical to SEQ ID NO: 47242
  neuraminidase__InfluenzaA__AFN17677

SEQ ID NO: 53202 - RNA, 1410 nt, Artificial Sequence; identical to SEQ ID NO: 53194
  neuraminidase__InfluenzaA__AFN17687

SEQ ID NO: 53203 - RNA, 1410 nt, Artificial Sequence; identical to SEQ ID NO: 47242
  neuraminidase__InfluenzaA__AFN17697

SEQ ID NO: 53204 - RNA, 1410 nt, Artificial Sequence; identical to SEQ ID NO: 53194
  neuraminidase__InfluenzaA__AFN17707

SEQ ID NO: 53205 - RNA, 1410 nt, Artificial Sequence; identical to SEQ ID NO: 50080
  neuraminidase__InfluenzaA__AFN17717

SEQ ID NO: 53206 - RNA, 1410 nt, Artificial Sequence; identical to SEQ ID NO: 52875
  neuraminidase__InfluenzaA__AFN17727

SEQ ID NO: 53207 - RNA, 1410 nt, Artificial Sequence
  neuraminidase__InfluenzaA__AFN17737
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacauggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53208 - RNA, 1410 nt, Artificial Sequence; identical to SEQ ID NO: 47242
  neuraminidase__InfluenzaA__AFN17743

SEQ ID NO: 53209 - RNA, 1410 nt, Artificial Sequence; identical to SEQ ID NO: 53194
  neuraminidase__InfluenzaA__AFN17749

SEQ ID NO: 53210 - RNA, 1410 nt, Artificial Sequence; identical to SEQ ID NO: 47242
  neuraminidase__InfluenzaA__AFN17759

SEQ ID NO: 53211 - RNA, 1410 nt, Artificial Sequence; identical to SEQ ID NO: 50080
  neuraminidase__InfluenzaA__AFN17769

SEQ ID NO: 53212 - RNA, 1410 nt, Artificial Sequence
  neuraminidase__InfluenzaA__AFN17775
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguucgucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53213 - RNA, 1410 nt, Artificial Sequence
  neuraminidase__InfluenzaA__AFN17785
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaccuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53214 - RNA, 1410 nt, Artificial Sequence
  neuraminidase__InfluenzaA__AFN17795
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguugguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53215 - RNA, 1410 nt, Artificial Sequence; identical to SEQ ID NO: 47242
  neuraminidase__InfluenzaA__AFN17805

SEQ ID NO: 53216 - RNA, 1410 nt, Artificial Sequence
  neuraminidase__InfluenzaA__AFN17815
augaauccaaaccaaaagauaauaaccauugguucggucaguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaaugggaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 53217 - RNA, 1410 nt, Artificial Sequence; identical to SEQ ID NO: 47242
  neuraminidase__InfluenzaA__AFN17825

SEQ ID NO: 53218 - RNA, 1410 nt, Artificial Sequence; identical to SEQ ID NO: 53194
  neuraminidase__InfluenzaA__AFN17835

SEQ ID NO: 53219 - RNA, 1410 nt, Artificial Sequence; identical to SEQ ID NO: 47242
  neuraminidase__InfluenzaA__AFN17845

SEQ ID NO: 53220 - RNA, 1410 nt, Artificial Sequence; identical to SEQ ID NO: 47242
  neuraminidase__InfluenzaA__AFN17855

SEQ ID NO: 53221 - RNA, 1410 nt, Artificial Sequence
  neuraminidase__InfluenzaA__AFN17865
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53222 - RNA, 1410 nt, Artificial Sequence
  neuraminidase__InfluenzaA__AFN17875
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaauuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53223 - RNA, 1410 nt, Artificial Sequence; identical to SEQ ID NO: 53194
  neuraminidase__InfluenzaA__AFN17885

SEQ ID NO: 53224 - RNA, 1410 nt, Artificial Sequence; identical to SEQ ID NO: 47242
  neuraminidase__InfluenzaA__AFN17895

SEQ ID NO: 53225 - RNA, 1410 nt, Artificial Sequence; identical to SEQ ID NO: 53194
  neuraminidase__InfluenzaA__AFN17905

SEQ ID NO: 53226 - RNA, 1410 nt, Artificial Sequence; identical to SEQ ID NO: 47242
  neuraminidase__InfluenzaA__AFN17911

SEQ ID NO: 53227 - RNA, 1410 nt, Artificial Sequence; identical to SEQ ID NO: 53194
  neuraminidase__InfluenzaA__AFN17921

SEQ ID NO: 53228 - RNA, 1410 nt, Artificial Sequence
  neuraminidase__InfluenzaA__AFN17931
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaggggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53229 - RNA, 1410 nt, Artificial Sequence
  neuraminidase__InfluenzaA__AFN17941
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggagugaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53230 - RNA, 1410 nt, Artificial Sequence; identical to SEQ ID NO: 47242
  neuraminidase__InfluenzaA__AFN17951

SEQ ID NO: 53231 - RNA, 1410 nt, Artificial Sequence
  neuraminidase__InfluenzaA__AFN17961
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaacucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53232 - RNA, 1410 nt, Artificial Sequence; identical to SEQ ID NO: 47242
  neuraminidase__InfluenzaA__AFN17971

SEQ ID NO: 53233 - RNA, 1410 nt, Artificial Sequence; identical to SEQ ID NO: 48035
  neuraminidase__InfluenzaA__AFN17981

SEQ ID NO: 53234 - RNA, 1410 nt, Artificial Sequence; identical to SEQ ID NO: 47242
  neuraminidase__InfluenzaA__AFN17991

SEQ ID NO: 53235 - RNA, 1410 nt, Artificial Sequence
  neuraminidase__InfluenzaA__AFN18001
augaauccaaaccaaaagauaauaaccauuaguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53236 - RNA, 1410 nt, Artificial Sequence; identical to SEQ ID NO: 47242
  neuraminidase__InfluenzaA__AFN18011

SEQ ID NO: 53237 - RNA, 1410 nt, Artificial Sequence; identical to SEQ ID NO: 47242
  neuraminidase__InfluenzaA__AFN18021

SEQ ID NO: 53238 - RNA, 1410 nt, Artificial Sequence
  neuraminidase__InfluenzaA__AFN18031
augaauccaaaccaaaagauaauaaccauugguucgaucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53239 - RNA, 1410 nt, Artificial Sequence; identical to SEQ ID NO: 47242
  neuraminidase__InfluenzaA__AFN18041

SEQ ID NO: 53240 - RNA, 1410 nt, Artificial Sequence; identical to SEQ ID NO: 53194
  neuraminidase__InfluenzaA__AFN18051

SEQ ID NO: 53241 - RNA, 1410 nt, Artificial Sequence; identical to SEQ ID NO: 53194
  neuraminidase__InfluenzaA__AFN18061

SEQ ID NO: 53242 - RNA, 1410 nt, Artificial Sequence; identical to SEQ ID NO: 47242
  neuraminidase__InfluenzaA__AFN18070

SEQ ID NO: 53243 - RNA, 1410 nt, Artificial Sequence; identical to SEQ ID NO: 47242
  neuraminidase__InfluenzaA__AFN18080

SEQ ID NO: 53244 - RNA, 1410 nt, Artificial Sequence; identical to SEQ ID NO: 47242
  neuraminidase__InfluenzaA__AFN18090

SEQ ID NO: 53245 - RNA, 1410 nt, Artificial Sequence; identical to SEQ ID NO: 49492
  neuraminidase__InfluenzaA__AFN18100

SEQ ID NO: 53246 - RNA, 1410 nt, Artificial Sequence; identical to SEQ ID NO: 47242
  neuraminidase__InfluenzaA__AFN18106

SEQ ID NO: 53247 - RNA, 1410 nt, Artificial Sequence
  neuraminidase__InfluenzaA__AFN18108
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguauugucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53248 - RNA, 1410 nt, Artificial Sequence
  neuraminidase__InfluenzaA__AFN18118
augaauccaaaccaaaagauaauaaccauugguucggucuguaugacaauuggaauggcuaacuuaauauuacaaauuggaaacaugaucucaauauggauuagccacucaauucaacuugggaaucaaaaucagauugaaacaugcaaucaaagcgucauuacuuaugaaaacaacacuuggguaaaucagacauauguuaagaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53249 - RNA, 1410 nt, Artificial Sequence; identical to SEQ ID NO: 47242
  neuraminidase__InfluenzaA__AFN18120

SEQ ID NO: 53250 - RNA, 1410 nt, Artificial Sequence; identical to SEQ ID NO: 47242
  neuraminidase__InfluenzaA__AFN18122

SEQ ID NO: 53251 - RNA, 1410 nt, Artificial Sequence; identical to SEQ ID NO: 53194
  neuraminidase__InfluenzaA__AFN18128

SEQ ID NO: 53252 - RNA, 1410 nt, Artificial Sequence; identical to SEQ ID NO: 53194
  neuraminidase__InfluenzaA__AFN18134

SEQ ID NO: 53253 - RNA, 1410 nt, Artificial Sequence
  neuraminidase__InfluenzaA__AFN18136
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugccccguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuauuaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggagugaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53254 - RNA, 1410 nt, Artificial Sequence; identical to SEQ ID NO: 47242
  neuraminidase__InfluenzaA__AFN18138

SEQ ID NO: 53255 - RNA, 1410 nt, Artificial Sequence
  neuraminidase__InfluenzaA__AFN18140
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguauuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53256 - RNA, 1410 nt, Artificial Sequence; identical to SEQ ID NO: 47242
  neuraminidase__InfluenzaA__AFN18144

SEQ ID NO: 53257 - RNA, 1410 nt, Artificial Sequence; identical to SEQ ID NO: 47242
  neuraminidase__InfluenzaA__AFN18150

SEQ ID NO: 53258 - RNA, 1410 nt, Artificial Sequence
  neuraminidase__InfluenzaA__AFN18156
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaauaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugaucugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcggaagcagcauauccuuuugugguguaaacagugacacuguggguuggucuuggccagacggugcugaguugccauuuaccauugacaaguaa

SEQ ID NO: 53259 - RNA, 1410 nt, Artificial Sequence; identical to SEQ ID NO: 51083
  neuraminidase__InfluenzaA__AFN18158

SEQ ID NO: 53260 - RNA, 1410 nt, Artificial Sequence; identical to SEQ ID NO: 53221
  neuraminidase__InfluenzaA__AFN18160

SEQ ID NO: 53261 - RNA, 1410 nt, Artificial Sequence
  neuraminidase__InfluenzaA__AFN18166
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaagacuuggguaaaucagacauauguuaacaucagcaacgccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaaaauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccuuuuaccauugacaaguaa

SEQ ID NO: 53262 - RNA, 1410 nt, Artificial Sequence; identical to SEQ ID NO: 48278
  neuraminidase__InfluenzaA__AFN18172

SEQ ID NO: 53263 - RNA, 1410 nt, Artificial Sequence
  neuraminidase__InfluenzaA__AFN18178
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcugugcuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53264 - RNA, 1410 nt, Artificial Sequence
  neuraminidase__InfluenzaA__AFN18184
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaaugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcucauguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacaggacuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53265 - RNA, 1410 nt, Artificial Sequence
  neuraminidase__InfluenzaA__AFN18190
augaauccaaaccaaaagauaauaaccauugguucggucuguaugacaauuggaauggcuaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaugacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53266 - RNA, 1410 nt, Artificial Sequence
  neuraminidase__InfluenzaA__AFN18196
augaauccaaaccaaaagauaauaaccauugguucggucuguaugacaauuggaauggcuaacuuaauauuacaaauuggaaacauaaccucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauuaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53267 - RNA, 1410 nt, Artificial Sequence
  neuraminidase__InfluenzaA__AFN18202
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacggucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53268 - RNA, 1410 nt, Artificial Sequence; identical to SEQ ID NO: 48268
  neuraminidase__InfluenzaA__AFN18208

SEQ ID NO: 53269 - RNA, 1410 nt, Artificial Sequence
  neuraminidase__InfluenzaA__AFN18210
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagagccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacucaaagagaacacaaucuggacuagcgggagcagcauauccuuuugugguguaaacagugacacuguggguuggucuuggccagacggugcugaguugccauuuaccauugacaaguaa

SEQ ID NO: 53270 - RNA, 1410 nt, Artificial Sequence; identical to SEQ ID NO: 50025
  neuraminidase__InfluenzaA__AFN18216

SEQ ID NO: 53271 - RNA, 1410 nt, Artificial Sequence
  neuraminidase__InfluenzaA__AFN18226
augaauccaaaccaaaagauaauaaccauugguucggucuguaugacaauuggaaugacuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53272 - RNA, 1410 nt, Artificial Sequence; identical to SEQ ID NO: 49341
  neuraminidase__InfluenzaA__AFN18232

SEQ ID NO: 53273 - RNA, 1410 nt, Artificial Sequence; identical to SEQ ID NO: 48462
  neuraminidase__InfluenzaA__AFN18234

SEQ ID NO: 53274 - RNA, 1410 nt, Artificial Sequence; identical to SEQ ID NO: 51771
  neuraminidase__InfluenzaA__AFN18244

SEQ ID NO: 53275 - RNA, 1410 nt, Artificial Sequence
  neuraminidase__InfluenzaA__AFN18246
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaauaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcauaaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuacccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaacgaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53276 - RNA, 1410 nt, Artificial Sequence; identical to SEQ ID NO: 53271
  neuraminidase__InfluenzaA__AFN18256

SEQ ID NO: 53277 - RNA, 1410 nt, Artificial Sequence; identical to SEQ ID NO: 51771
  neuraminidase__InfluenzaA__AFN18262

SEQ ID NO: 53278 - RNA, 1410 nt, Artificial Sequence; identical to SEQ ID NO: 51771
  neuraminidase__InfluenzaA__AFN18268

SEQ ID NO: 53279 - RNA, 1410 nt, Artificial Sequence
  neuraminidase__InfluenzaA__AFN18270
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugauaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacggcuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53280 - RNA, 1410 nt, Artificial Sequence
  neuraminidase__InfluenzaA__AFN18272
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacacuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauguccuuuugugguguaaacagugacacuguggguuggucuuggccagacggugcugaguugccauuuaccauugacaaguaa

SEQ ID NO: 53281 - RNA, 1410 nt, Artificial Sequence; identical to SEQ ID NO: 49341
  neuraminidase__InfluenzaA__AFN18274

SEQ ID NO: 53282 - RNA, 1410 nt, Artificial Sequence; identical to SEQ ID NO: 48880
  neuraminidase__InfluenzaA__AFN18282

SEQ ID NO: 53283 - RNA, 1410 nt, Artificial Sequence
  neuraminidase__InfluenzaA__AFN18304
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaauacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaacuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgacggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 53284 - RNA, 1410 nt, Artificial Sequence
  neuraminidase__InfluenzaA__AFN18306
augaauccaaaccaaaagauaauaaccauugguucggucuguaugacaauuggaauugcuaacuuaauauuacaaauuggaaacauaaucucaauauggauuagccacucaauucaacuugggaaucaaaaucagauugaaacaugcaaccaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53285 - RNA, 1410 nt, Artificial Sequence
  neuraminidase__InfluenzaA__AFN18308
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuagaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaaaggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53286 - RNA, 1410 nt, Artificial Sequence
  neuraminidase__InfluenzaA__AFN18314
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaccagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaaaacaaucuggacuagcgggagcagcauauccuuuugugguguaaacagugacacuguggguuggucuuggccagacggugcugaguugccauuuaccauugacaaguaa

SEQ ID NO: 53287 - RNA, 1410 nt, Artificial Sequence; identical to SEQ ID NO: 48880
  neuraminidase__InfluenzaA__AFN18320

SEQ ID NO: 53288 - RNA, 1410 nt, Artificial Sequence
  neuraminidase__InfluenzaA__AFN18326
augaauccaaaccaaaagauaauaaccauugguucggucuguaugacaauuggaauggcuaacuuacuauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcugacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53289 - RNA, 1410 nt, Artificial Sequence; identical to SEQ ID NO: 47306
  neuraminidase__InfluenzaA__AFN18336

SEQ ID NO: 53290 - RNA, 1410 nt, Artificial Sequence; identical to SEQ ID NO: 47242
  neuraminidase__InfluenzaA__AFN18346

SEQ ID NO: 53291 - RNA, 1410 nt, Artificial Sequence; identical to SEQ ID NO: 53194
  neuraminidase__InfluenzaA__AFN18356

SEQ ID NO: 53292 - RNA, 1410 nt, Artificial Sequence
  neuraminidase__InfluenzaA__AFN18366
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaagucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugaaaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53293 - RNA, 1410 nt, Artificial Sequence; identical to SEQ ID NO: 53170
  neuraminidase__InfluenzaA__AFN18376

SEQ ID NO: 53294 - RNA, 1410 nt, Artificial Sequence; identical to SEQ ID NO: 47242
  neuraminidase__InfluenzaA__AFN18382

SEQ ID NO: 53295 - RNA, 1410 nt, Artificial Sequence; identical to SEQ ID NO: 49366
  neuraminidase__InfluenzaA__AFN18392

SEQ ID NO: 53296 - RNA, 1410 nt, Artificial Sequence; identical to SEQ ID NO: 47242
  neuraminidase__InfluenzaA__AFN18402

SEQ ID NO: 53297 - RNA, 1410 nt, Artificial Sequence; identical to SEQ ID NO: 47242
  neuraminidase__InfluenzaA__AFN18412

SEQ ID NO: 53298 - RNA, 1410 nt, Artificial Sequence; identical to SEQ ID NO: 47242
  neuraminidase__InfluenzaA__AFN18422

SEQ ID NO: 53299 - RNA, 1410 nt, Artificial Sequence; identical to SEQ ID NO: 47242
  neuraminidase__InfluenzaA__AFN18432

SEQ ID NO: 53300 - RNA, 1410 nt, Artificial Sequence; identical to SEQ ID NO: 47242
  neuraminidase__InfluenzaA__AFN18442

SEQ ID NO: 53301 - RNA, 1410 nt, Artificial Sequence; identical to SEQ ID NO: 47242
  neuraminidase__InfluenzaA__AFN18452

SEQ ID NO: 53302 - RNA, 1410 nt, Artificial Sequence; identical to SEQ ID NO: 47242
  neuraminidase__InfluenzaA__AFN18462

SEQ ID NO: 53303 - RNA, 1410 nt, Artificial Sequence
  neuraminidase__InfluenzaA__AFN18472
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaagggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53304 - RNA, 1410 nt, Artificial Sequence; identical to SEQ ID NO: 47242
  neuraminidase__InfluenzaA__AFN18482

SEQ ID NO: 53305 - RNA, 1410 nt, Artificial Sequence; identical to SEQ ID NO: 48035
  neuraminidase__InfluenzaA__AFN18492

SEQ ID NO: 53306 - RNA, 1410 nt, Artificial Sequence
  neuraminidase__InfluenzaA__AFN18514
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53307 - RNA, 1410 nt, Artificial Sequence
  neuraminidase__InfluenzaA__AFN18520
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53308 - RNA, 1410 nt, Artificial Sequence
  neuraminidase__InfluenzaA__AFN18522
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaauacaaucuggacuagcgggagcagcauauccuuuugugguguaaacagugacacuguggguuggucuuggccagacggugcugaguugccauuuaccauugacaaguaa

SEQ ID NO: 53309 - RNA, 1410 nt, Artificial Sequence; identical to SEQ ID NO: 47242
  neuraminidase__InfluenzaA__AFN18524

SEQ ID NO: 53310 - RNA, 1410 nt, Artificial Sequence; identical to SEQ ID NO: 53194
  neuraminidase__InfluenzaA__AFN18530

SEQ ID NO: 53311 - RNA, 1410 nt, Artificial Sequence; identical to SEQ ID NO: 49266
  neuraminidase__InfluenzaA__AFN18532

SEQ ID NO: 53312 - RNA, 1410 nt, Artificial Sequence; identical to SEQ ID NO: 47242
  neuraminidase__InfluenzaA__AFN18538

SEQ ID NO: 53313 - RNA, 1410 nt, Artificial Sequence; identical to SEQ ID NO: 47242
  neuraminidase__InfluenzaA__AFN18544

SEQ ID NO: 53314 - RNA, 1410 nt, Artificial Sequence; identical to SEQ ID NO: 47242
  neuraminidase__InfluenzaA__AFN18546

SEQ ID NO: 53315 - RNA, 1410 nt, Artificial Sequence
  neuraminidase__InfluenzaA__AFN18552
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggagcuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53316 - RNA, 1410 nt, Artificial Sequence; identical to SEQ ID NO: 48264
  neuraminidase__InfluenzaA__AFN18558

SEQ ID NO: 53317 - RNA, 1410 nt, Artificial Sequence; identical to SEQ ID NO: 51477
  neuraminidase__InfluenzaA__AFN18560

SEQ ID NO: 53318 - RNA, 1410 nt, Artificial Sequence; identical to SEQ ID NO: 49492
  neuraminidase__InfluenzaA__AFN18562

SEQ ID NO: 53319 - RNA, 1410 nt, Artificial Sequence
  neuraminidase__InfluenzaA__AFN18564
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53320 - RNA, 1410 nt, Artificial Sequence
  neuraminidase__InfluenzaA__AFN18566
augaauccaaaccaaaagauaauaaccauugguucggucuguaugacaauuggaauggcuaacuuaauauuacaaaucggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53321 - RNA, 1410 nt, Artificial Sequence; identical to SEQ ID NO: 47242
  neuraminidase__InfluenzaA__AFN18572

SEQ ID NO: 53322 - RNA, 1410 nt, Artificial Sequence
  neuraminidase__InfluenzaA__AFN18582
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaccuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53323 - RNA, 1410 nt, Artificial Sequence; identical to SEQ ID NO: 47242
  neuraminidase__InfluenzaA__AFN18592

SEQ ID NO: 53324 - RNA, 1410 nt, Artificial Sequence
  neuraminidase__InfluenzaA__AFN18602
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucaaacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53325 - RNA, 1410 nt, Artificial Sequence
  neuraminidase__InfluenzaA__AFN18612
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53326 - RNA, 1410 nt, Artificial Sequence
  neuraminidase__InfluenzaA__AFN18618
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcacccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53327 - RNA, 1410 nt, Artificial Sequence
  neuraminidase__InfluenzaA__AFN18624
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccaaacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacgguaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53328 - RNA, 1410 nt, Artificial Sequence
  neuraminidase__InfluenzaA__AFN18630
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacauggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggaucuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggguuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53329 - RNA, 1410 nt, Artificial Sequence
  neuraminidase__InfluenzaA__AFN18636
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgauccaaagagaacacaaucuggacuagcgggagcagcauauccuuuugugguguaaacagugacacuguggguuggucuuggccagacggugcugaguugccauuuaccauugacaaguaa

SEQ ID NO: 53330 - RNA, 1410 nt, Artificial Sequence; identical to SEQ ID NO: 47242
  neuraminidase__InfluenzaA__AFN18646

SEQ ID NO: 53331 - RNA, 1410 nt, Artificial Sequence; identical to SEQ ID NO: 47242
  neuraminidase__InfluenzaA__AFN18656

SEQ ID NO: 53332 - RNA, 1410 nt, Artificial Sequence
  neuraminidase__InfluenzaA__AFN18666
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaucauugacaaguaa

SEQ ID NO: 53333 - RNA, 1410 nt, Artificial Sequence
  neuraminidase__InfluenzaA__AFN18676
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53334 - RNA, 1410 nt, Artificial Sequence
  neuraminidase__InfluenzaA__AFN18686
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcagcaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53335 - RNA, 1410 nt, Artificial Sequence; identical to SEQ ID NO: 47242
  neuraminidase__InfluenzaA__AFN18696

SEQ ID NO: 53336 - RNA, 1410 nt, Artificial Sequence; identical to SEQ ID NO: 49829
  neuraminidase__InfluenzaA__AFN18706

SEQ ID NO: 53337 - RNA, 1410 nt, Artificial Sequence; identical to SEQ ID NO: 47242
  neuraminidase__InfluenzaA__AFN18716

SEQ ID NO: 53338 - RNA, 1410 nt, Artificial Sequence; identical to SEQ ID NO: 47242
  neuraminidase__InfluenzaA__AFN18727

SEQ ID NO: 53339 - RNA, 1410 nt, Artificial Sequence
  neuraminidase__InfluenzaA__AFN18737
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaaucggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugguuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53340 - RNA, 1410 nt, Artificial Sequence
  neuraminidase__InfluenzaA__AFN18743
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuuuuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53341 - RNA, 1410 nt, Artificial Sequence
  neuraminidase__InfluenzaA__AFN18749
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacaccuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53342 - RNA, 1410 nt, Artificial Sequence; identical to SEQ ID NO: 47242
  neuraminidase__InfluenzaA__AFN18759

SEQ ID NO: 53343 - RNA, 1410 nt, Artificial Sequence
  neuraminidase__InfluenzaA__AFN18769
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuaaugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53344 - RNA, 1410 nt, Artificial Sequence
  neuraminidase__InfluenzaA__AFN18775
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53345 - RNA, 1410 nt, Artificial Sequence
  neuraminidase__InfluenzaA__AFN18777
augaauccaaaccaaaagauaauaaccauugguucggucuguaugacaauuggaauggcuaacuuaauauuacaaauuggaaacauaaucucaauauggauuagccacucaauucaacuuggaaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauauggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53346 - RNA, 1410 nt, Artificial Sequence; identical to SEQ ID NO: 49492
  neuraminidase__InfluenzaA__AFN18779

SEQ ID NO: 53347 - RNA, 1410 nt, Artificial Sequence
  neuraminidase__InfluenzaA__AFN18785
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggaguccauaucgaacccuaaugagcuguccuauuggugaaguucccucuccauacaacucaagguuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaggcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53348 - RNA, 1410 nt, Artificial Sequence
  neuraminidase__InfluenzaA__AFN18791
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccaucaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugaaucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53349 - RNA, 1410 nt, Artificial Sequence; identical to SEQ ID NO: 48836
  neuraminidase__InfluenzaA__AFN18801

SEQ ID NO: 53350 - RNA, 1410 nt, Artificial Sequence
  neuraminidase__InfluenzaA__AFN18811
augaauccaaaccaaaagauaauaaccauugguucgaucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53351 - RNA, 1410 nt, Artificial Sequence; identical to SEQ ID NO: 53341
  neuraminidase__InfluenzaA__AFN18817

SEQ ID NO: 53352 - RNA, 1410 nt, Artificial Sequence; identical to SEQ ID NO: 47242
  neuraminidase__InfluenzaA__AFN18819

SEQ ID NO: 53353 - RNA, 1410 nt, Artificial Sequence; identical to SEQ ID NO: 50234
  neuraminidase__InfluenzaA__AFN18821

SEQ ID NO: 53354 - RNA, 1410 nt, Artificial Sequence; identical to SEQ ID NO: 47298
  neuraminidase__InfluenzaA__AFN18823

SEQ ID NO: 53355 - RNA, 1410 nt, Artificial Sequence; identical to SEQ ID NO: 47242
  neuraminidase__InfluenzaA__AFN18825

SEQ ID NO: 53356 - RNA, 1410 nt, Artificial Sequence
  neuraminidase__InfluenzaA__AFN18827
augaauccaaaccaaaagauaauaaccauugguucggucuguaugacaauuggaauggcuaacuuaauauuacaaauuggaaacauaaucucaauauggauuagccacucaauucagcuugggaaucaaaaucagauugaaacaugcaaucaaagcgucauuacuuaugaaaacaacacuuggguaaaucagacauauguuaacaucagcaacaccaacuuugcugcuggacagucggugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53357 - RNA, 1410 nt, Artificial Sequence; identical to SEQ ID NO: 47975
  neuraminidase__InfluenzaA__AFN18829

SEQ ID NO: 53358 - RNA, 1410 nt, Artificial Sequence; identical to SEQ ID NO: 47242
  neuraminidase__InfluenzaA__AFN18831

SEQ ID NO: 53359 - RNA, 1410 nt, Artificial Sequence; identical to SEQ ID NO: 48379
  neuraminidase__InfluenzaA__AFN18833

SEQ ID NO: 53360 - RNA, 1410 nt, Artificial Sequence
  neuraminidase__InfluenzaA__AFN18835
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccaucaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagguagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53361 - RNA, 1410 nt, Artificial Sequence; identical to SEQ ID NO: 47242
  neuraminidase__InfluenzaA__AFN18841

SEQ ID NO: 53362 - RNA, 1410 nt, Artificial Sequence
  neuraminidase__InfluenzaA__AFN18851
augaauccaaaccaaaagauaauaaccauugguucggucuguaugacaauuggaauggcuaacuuaauauuacaaauuggaaacaugaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53363 - RNA, 1410 nt, Artificial Sequence
  neuraminidase__InfluenzaA__AFN18857
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuguuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53364 - RNA, 1410 nt, Artificial Sequence
  neuraminidase__InfluenzaA__AFN18859
augaauccaaaccaaaagauaauaaccauugguucggucuguaugacaauuggacuggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53365 - RNA, 1410 nt, Artificial Sequence
  neuraminidase__InfluenzaA__AFN18861
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcucuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53366 - RNA, 1410 nt, Artificial Sequence; identical to SEQ ID NO: 47242
  neuraminidase__InfluenzaA__AFN18867

SEQ ID NO: 53367 - RNA, 1410 nt, Artificial Sequence
  neuraminidase__InfluenzaA__AFN18877
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacuaucuggacuagcgggagcagcauauccuuuugugguguaaacagugacacuguggguuggucuuggccagacggugcugaguugccauuuaccauugacaaguaa

SEQ ID NO: 53368 - RNA, 1410 nt, Artificial Sequence; identical to SEQ ID NO: 47242
  neuraminidase__InfluenzaA__AFN18887

SEQ ID NO: 53369 - RNA, 1410 nt, Artificial Sequence
  neuraminidase__InfluenzaA__AFN18893
augaauccaaaccaaaagauaauaaccauugguucggucuguaugacaauuggaauggcuaacuuaauauuacaaauuggaaacauaaucucaauauggauuagccacucaauucagcuugggaaucaaaaucagauugaaacaugcaaucaaagcgucauuacuuaugaaaacaacacuuggguaaaucagacauauguuaacaucagcaacaccaacuuugcugcuggacagucggugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53370 - RNA, 1410 nt, Artificial Sequence
  neuraminidase__InfluenzaA__AFN18895
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucaaagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53371 - RNA, 1410 nt, Artificial Sequence; identical to SEQ ID NO: 50125
  neuraminidase__InfluenzaA__AFN18905

SEQ ID NO: 53372 - RNA, 1410 nt, Artificial Sequence; identical to SEQ ID NO: 53221
  neuraminidase__InfluenzaA__AFN18913

SEQ ID NO: 53373 - RNA, 1410 nt, Artificial Sequence
  neuraminidase__InfluenzaA__AFN18919
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacaccuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagaaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53374 - RNA, 1410 nt, Artificial Sequence
  neuraminidase__InfluenzaA__AFN18929
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggucagacggugcugaguugccauuuaccauugacaaguaa

SEQ ID NO: 53375 - RNA, 1410 nt, Artificial Sequence; identical to SEQ ID NO: 47242
  neuraminidase__InfluenzaA__AFN18939

SEQ ID NO: 53376 - RNA, 1410 nt, Artificial Sequence; identical to SEQ ID NO: 47707
  neuraminidase__InfluenzaA__AFN18953

SEQ ID NO: 53377 - RNA, 1410 nt, Artificial Sequence; identical to SEQ ID NO: 47975
  neuraminidase__InfluenzaA__AFN18959

SEQ ID NO: 53378 - RNA, 1410 nt, Artificial Sequence; identical to SEQ ID NO: 53275
  neuraminidase__InfluenzaA__AFN18965

SEQ ID NO: 53379 - RNA, 1410 nt, Artificial Sequence
  neuraminidase__InfluenzaA__AFN18975
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauaguuaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaggaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 53380 - RNA, 1410 nt, Artificial Sequence; identical to SEQ ID NO: 49341
  neuraminidase__InfluenzaA__AFN18981

SEQ ID NO: 53381 - RNA, 1410 nt, Artificial Sequence
  neuraminidase__InfluenzaA__AFN18983
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaccagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccucuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacagggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccggacggugcugaguugccauuuaccauugacaaguaa

SEQ ID NO: 53382 - RNA, 1410 nt, Artificial Sequence; identical to SEQ ID NO: 51771
  neuraminidase__InfluenzaA__AFN18985

SEQ ID NO: 53383 - RNA, 1410 nt, Artificial Sequence
  neuraminidase__InfluenzaA__AFN18987
augaauccaaaccaaaagauaauaaccauugguucggucuguaugacaauuggaauggcuaacuuaauauuacaaauuggaaacauaaucucaauauggauuagccacucaauucagcuugggaaucaaaaucagauugaaacaugcaaucaaagcgucauuacuuaugaaaacaacacuuggguaaaucagacauauguuaacaucagcaacaccaacuuugcugcuggacagucggugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaacccacgcccuauugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53384 - RNA, 1410 nt, Artificial Sequence; identical to SEQ ID NO: 47242
  neuraminidase__InfluenzaA__AFN18989

SEQ ID NO: 53385 - RNA, 1410 nt, Artificial Sequence; identical to SEQ ID NO: 47242
  neuraminidase__InfluenzaA__AFN18995

SEQ ID NO: 53386 - RNA, 1410 nt, Artificial Sequence
  neuraminidase__InfluenzaA__AFN19001
augaauccaaaccaaaagauaauaaccauugguucggucuguaugacaauuggauuggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53387 - RNA, 1410 nt, Artificial Sequence; identical to SEQ ID NO: 48462
  neuraminidase__InfluenzaA__AFN19007

SEQ ID NO: 53388 - RNA, 1410 nt, Artificial Sequence; identical to SEQ ID NO: 47242
  neuraminidase__InfluenzaA__AFN19024

SEQ ID NO: 53389 - RNA, 1410 nt, Artificial Sequence
  neuraminidase__InfluenzaA__AFN19025
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauucuaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaaaauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53390 - RNA, 1410 nt, Artificial Sequence; identical to SEQ ID NO: 47242
  neuraminidase__InfluenzaA__AFN19027

SEQ ID NO: 53391 - RNA, 1410 nt, Artificial Sequence; identical to SEQ ID NO: 48286
  neuraminidase__InfluenzaA__AFN19032

SEQ ID NO: 53392 - RNA, 1410 nt, Artificial Sequence; identical to SEQ ID NO: 47242
  neuraminidase__InfluenzaA__AFN19038

SEQ ID NO: 53393 - RNA, 1410 nt, Artificial Sequence; identical to SEQ ID NO: 53194
  neuraminidase__InfluenzaA__AFN19049

SEQ ID NO: 53394 - RNA, 1410 nt, Artificial Sequence; identical to SEQ ID NO: 47242
  neuraminidase__InfluenzaA__AFN19055

SEQ ID NO: 53395 - RNA, 1410 nt, Artificial Sequence; identical to SEQ ID NO: 47242
  neuraminidase__InfluenzaA__AFN19065

SEQ ID NO: 53396 - RNA, 1410 nt, Artificial Sequence; identical to SEQ ID NO: 47242
  neuraminidase__InfluenzaA__AFN19071

SEQ ID NO: 53397 - RNA, 1410 nt, Artificial Sequence
  neuraminidase__InfluenzaA__AFN19077
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggggacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53398 - RNA, 1410 nt, Artificial Sequence; identical to SEQ ID NO: 47242
  neuraminidase__InfluenzaA__AFN19083

SEQ ID NO: 53399 - RNA, 1410 nt, Artificial Sequence; identical to SEQ ID NO: 47242
  neuraminidase__InfluenzaA__AFN19089

SEQ ID NO: 53400 - RNA, 1410 nt, Artificial Sequence; identical to SEQ ID NO: 47242
  neuraminidase__InfluenzaA__AFN19099

SEQ ID NO: 53401 - RNA, 1410 nt, Artificial Sequence; identical to SEQ ID NO: 47242
  neuraminidase__InfluenzaA__AFN19105

SEQ ID NO: 53402 - RNA, 1410 nt, Artificial Sequence; identical to SEQ ID NO: 47242
  neuraminidase__InfluenzaA__AFN19114

SEQ ID NO: 53403 - RNA, 1410 nt, Artificial Sequence; identical to SEQ ID NO: 47242
  neuraminidase__InfluenzaA__AFN19126

SEQ ID NO: 53404 - RNA, 1410 nt, Artificial Sequence; identical to SEQ ID NO: 47242
  neuraminidase__InfluenzaA__AFN19136

SEQ ID NO: 53405 - RNA, 1410 nt, Artificial Sequence; identical to SEQ ID NO: 47242
  neuraminidase__InfluenzaA__AFN19146

SEQ ID NO: 53406 - RNA, 1410 nt, Artificial Sequence; identical to SEQ ID NO: 47242
  neuraminidase__InfluenzaA__AFN19156

SEQ ID NO: 53407 - RNA, 1410 nt, Artificial Sequence; identical to SEQ ID NO: 47242
  neuraminidase__InfluenzaA__AFN19166

SEQ ID NO: 53408 - RNA, 1410 nt, Artificial Sequence; identical to SEQ ID NO: 47242
  neuraminidase__InfluenzaA__AFN19186

SEQ ID NO: 53409 - RNA, 1410 nt, Artificial Sequence; identical to SEQ ID NO: 53194
  neuraminidase__InfluenzaA__AFN19196

SEQ ID NO: 53410 - RNA, 1410 nt, Artificial Sequence; identical to SEQ ID NO: 47242
  neuraminidase__InfluenzaA__AFN19205

SEQ ID NO: 53411 - RNA, 1410 nt, Artificial Sequence; identical to SEQ ID NO: 47242
  neuraminidase__InfluenzaA__AFN19215

SEQ ID NO: 53412 - RNA, 1410 nt, Artificial Sequence; identical to SEQ ID NO: 47242
  neuraminidase__InfluenzaA__AFN19225

SEQ ID NO: 53413 - RNA, 1410 nt, Artificial Sequence; identical to SEQ ID NO: 47242
  neuraminidase__InfluenzaA__AFN19235

SEQ ID NO: 53414 - RNA, 1410 nt, Artificial Sequence; identical to SEQ ID NO: 47242
  neuraminidase__InfluenzaA__AFN19245

SEQ ID NO: 53415 - RNA, 1410 nt, Artificial Sequence
  neuraminidase__InfluenzaA__AFN19251
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggacaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53416 - RNA, 1410 nt, Artificial Sequence
  neuraminidase__InfluenzaA__AFN19261
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagcgauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53417 - RNA, 1410 nt, Artificial Sequence; identical to SEQ ID NO: 53194
  neuraminidase__InfluenzaA__AFN19271

SEQ ID NO: 53418 - RNA, 1410 nt, Artificial Sequence; identical to SEQ ID NO: 52134
  neuraminidase__InfluenzaA__AFN19281

SEQ ID NO: 53419 - RNA, 1410 nt, Artificial Sequence
  neuraminidase__InfluenzaA__AFN19287
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaagugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaccuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53420 - RNA, 1410 nt, Artificial Sequence; identical to SEQ ID NO: 47242
  neuraminidase__InfluenzaA__AFN19297

SEQ ID NO: 53421 - RNA, 1410 nt, Artificial Sequence; identical to SEQ ID NO: 47242
  neuraminidase__InfluenzaA__AFN19307

SEQ ID NO: 53422 - RNA, 1410 nt, Artificial Sequence; identical to SEQ ID NO: 49492
  neuraminidase__InfluenzaA__AFN19317

SEQ ID NO: 53423 - RNA, 1410 nt, Artificial Sequence; identical to SEQ ID NO: 53194
  neuraminidase__InfluenzaA__AFN19327

SEQ ID NO: 53424 - RNA, 1410 nt, Artificial Sequence; identical to SEQ ID NO: 47242
  neuraminidase__InfluenzaA__AFN19346

SEQ ID NO: 53425 - RNA, 1410 nt, Artificial Sequence
  neuraminidase__InfluenzaA__AFN19352
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcucaagcaguggccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaagugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53426 - RNA, 1410 nt, Artificial Sequence
  neuraminidase__InfluenzaA__AFN19354
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauaggucugguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53427 - RNA, 1410 nt, Artificial Sequence
  neuraminidase__InfluenzaA__AFN19356
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaauuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53428 - RNA, 1410 nt, Artificial Sequence
  neuraminidase__InfluenzaA__AFN19358
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggagacuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53429 - RNA, 1410 nt, Artificial Sequence
  neuraminidase__InfluenzaA__AFN19360
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53430 - RNA, 1410 nt, Artificial Sequence
  neuraminidase__InfluenzaA__AFN19362
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucacagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagaugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53431 - RNA, 1410 nt, Artificial Sequence
  neuraminidase__InfluenzaA__AFN19364
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacgauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53432 - RNA, 1410 nt, Artificial Sequence
  neuraminidase__InfluenzaA__AFN19366
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagaaauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaagauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53433 - RNA, 1410 nt, Artificial Sequence
  neuraminidase__InfluenzaA__AFN19370
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacgcccagaaaaaacgacagcuccagcaguagccauuguuuggauccuaacaaugaagaagguggucauggagugaaaggcugggccuuugaugauggaaaugacguuuggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53434 - RNA, 1410 nt, Artificial Sequence
  neuraminidase__InfluenzaA__AFN19374
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaauaccaccauagagaaggaaauaugccccaaaccagcagaauacagaaauuggucaaaaccgcaauguggcauuacaggauuugcaccuuucucuaaggacaauucgaucaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauuaaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaccgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53435 - RNA, 1410 nt, Artificial Sequence; identical to SEQ ID NO: 53429
  neuraminidase__InfluenzaA__AFN19376

SEQ ID NO: 53436 - RNA, 1410 nt, Artificial Sequence; identical to SEQ ID NO: 53433
  neuraminidase__InfluenzaA__AFN19378

SEQ ID NO: 53437 - RNA, 1410 nt, Artificial Sequence
  neuraminidase__InfluenzaA__AFN19380
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccaucagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcagaccucaaucucaugccuauauaa

SEQ ID NO: 53438 - RNA, 1410 nt, Artificial Sequence
  neuraminidase__InfluenzaA__AFN19382
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgaucaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauuaaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaccgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53439 - RNA, 1410 nt, Artificial Sequence
  neuraminidase__InfluenzaA__AFN19384
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucagaacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacgcccagaaaaaacgacagcuccagcaguagccauuguuuggauccuaacaaugaagaagguggucauggagugaaaggcugggccuuugaugauggaaaugacguuuggaugggaagaacaauuaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53440 - RNA, 1410 nt, Artificial Sequence
  neuraminidase__InfluenzaA__AFN19386
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucagaacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacgcccagaaaaaacgacagcuccagcaguagccauuguuuggauccuaacaaugaagaagguggucauggagugaaaggcugggccuuugaugauggaaaugacguuuggaugggaagaacaaucaacgagacgucacgcuuaggguaugaaaccuucaaagucauugaaggcugguccaacccuaaguccaaauugcagauaaauaggcaaaucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53441 - RNA, 1410 nt, Artificial Sequence; identical to SEQ ID NO: 53433
  neuraminidase__InfluenzaA__AFN19388

SEQ ID NO: 53442 - RNA, 1410 nt, Artificial Sequence; identical to SEQ ID NO: 53429
  neuraminidase__InfluenzaA__AFN19390

SEQ ID NO: 53443 - RNA, 1410 nt, Artificial Sequence
  neuraminidase__InfluenzaA__AFN19392
augaauccaaaucaaaagauaauaacgauuggcucuguuucucucaccauuuccacaauaugcuucuucaugcaaauugccgucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucgugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaaccccaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53444 - RNA, 1410 nt, Artificial Sequence; identical to SEQ ID NO: 52303
  neuraminidase__InfluenzaA__AFN19394

SEQ ID NO: 53445 - RNA, 1410 nt, Artificial Sequence
  neuraminidase__InfluenzaA__AFN19396
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugauauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuugugcgguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaagggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagaacugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53446 - RNA, 1410 nt, Artificial Sequence
  neuraminidase__InfluenzaA__AFN19398
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggagaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53447 - RNA, 1410 nt, Artificial Sequence
  neuraminidase__InfluenzaA__AFN19400
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccaucagaauacagaaauuggucaaaaccgcaaugugacauuacaggauuugcaccuuuuucuaaggacaauucgauuaggcuuuccgaugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53448 - RNA, 1410 nt, Artificial Sequence
  neuraminidase__InfluenzaA__AFN19402
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53449 - RNA, 1410 nt, Artificial Sequence
  neuraminidase__InfluenzaA__AFN19404
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccggcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53450 - RNA, 1410 nt, Artificial Sequence; identical to SEQ ID NO: 53448
  neuraminidase__InfluenzaA__AFN19406

SEQ ID NO: 53451 - RNA, 1410 nt, Artificial Sequence; identical to SEQ ID NO: 53429
  neuraminidase__InfluenzaA__AFN19410

SEQ ID NO: 53452 - RNA, 1410 nt, Artificial Sequence
  neuraminidase__InfluenzaA__AFN19412
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcacguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacgcccagaaaaaacgacagcuccagcaguagccauuguuuggauccuaacaaugaagaagguggucauggagugaaaggcugggccuuugaugauggaaaugacguuuggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53453 - RNA, 1410 nt, Artificial Sequence; identical to SEQ ID NO: 53448
  neuraminidase__InfluenzaA__AFN19414

SEQ ID NO: 53454 - RNA, 1410 nt, Artificial Sequence; identical to SEQ ID NO: 53429
  neuraminidase__InfluenzaA__AFN19416

SEQ ID NO: 53455 - RNA, 1410 nt, Artificial Sequence
  neuraminidase__InfluenzaA__AFN19418
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaagagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53456 - RNA, 1410 nt, Artificial Sequence
  neuraminidase__InfluenzaA__AFN19420
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53457 - RNA, 1410 nt, Artificial Sequence
  neuraminidase__InfluenzaA__AFN19422
augaauccaaaucaaaagauaauaacgauugguucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacggggaaugauaaaaaugcaacugcuagcuucauuuacaaugggaggcuuguagauaguguuguuucaugguccaaagaaguucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53458 - RNA, 1410 nt, Artificial Sequence
  neuraminidase__InfluenzaA__AFN19426
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugaugaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacgcccagaaaaaacgacagcuccagcaguagccauuguuuggauccuaacaaugaagaagguggucauggagugaaaggcugggccuuugaugauggaaaugacguuuggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53459 - RNA, 1410 nt, Artificial Sequence; identical to SEQ ID NO: 53433
  neuraminidase__InfluenzaA__AFN19428

SEQ ID NO: 53460 - RNA, 1410 nt, Artificial Sequence
  neuraminidase__InfluenzaA__AFN19430
augaauccaaaucaaaagauaauaacgauuggcucuguuucucucaccauuuccacaauaugcuucuucaugcaaauugccaucuugauaauuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucaacaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53461 - RNA, 1410 nt, Artificial Sequence
  neuraminidase__InfluenzaA__AFN19432
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccucaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucguuauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggaugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53462 - RNA, 1410 nt, Artificial Sequence
  neuraminidase__InfluenzaA__AFN19434
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53463 - RNA, 1410 nt, Artificial Sequence
  neuraminidase__InfluenzaA__AFN19436
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacagugcgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53464 - RNA, 1410 nt, Artificial Sequence
  neuraminidase__InfluenzaA__AFN19438
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugucuauauaa

SEQ ID NO: 53465 - RNA, 1410 nt, Artificial Sequence
  neuraminidase__InfluenzaA__AFN19442
augaauccaaaucaaaagauaauaacgauuggcucuguuucucuaaccauuuccacaauaugcuucuucaugcaaauugccaucuugauaacuacuguaacacugcacuucaagcaauaugaauucaacucccccccaaacaaccaagugaugcugugugaaccaacaauaauagaaagaaacauaacagagauaguguaucugaccaacaccaucauagagaaggaaauaugccccaaaccaacagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguuuguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugcauauauaa

SEQ ID NO: 53466 - RNA, 1410 nt, Artificial Sequence
  neuraminidase__InfluenzaA__AFN19446
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53467 - RNA, 1410 nt, Artificial Sequence; identical to SEQ ID NO: 53466
  neuraminidase__InfluenzaA__AFN19448

SEQ ID NO: 53468 - RNA, 1410 nt, Artificial Sequence; identical to SEQ ID NO: 53429
  neuraminidase__InfluenzaA__AFN19458

SEQ ID NO: 53469 - RNA, 1410 nt, Artificial Sequence
  neuraminidase__InfluenzaA__AFN19460
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaugaaauucucaggacccaggagucagaauguguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaauaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugagggcaaaagcugcaucaaucggugcuuuuauguggaguugauuaggggaagaaaagaggaaaaugaagucuuguggaccucaaacaguauuguuguguuuuguggcaccucagguacauauggaacaggcucauggccugauggggcggaccucaaucucaugccuauauaa

SEQ ID NO: 53470 - RNA, 1410 nt, Artificial Sequence
  neuraminidase__InfluenzaA__AFN19462
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaaguguguauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcauaaaucggugcuuuuauguggaguugauuaggggaagaaaagaggaaacugaagucuuguggaccucaaacaguauuguuguauuuuguggcaccucagguacauauggaacaggcucauggccugauggggcggaccucaaucucaugccuauauaa

SEQ ID NO: 53471 - RNA, 1410 nt, Artificial Sequence
  neuraminidase__InfluenzaA__AFN19466
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauugcaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaauccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53472 - RNA, 1410 nt, Artificial Sequence
  neuraminidase__InfluenzaA__AFN19468
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaauacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaagguaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53473 - RNA, 1410 nt, Artificial Sequence
  neuraminidase__InfluenzaA__AFN19470
augaauccaaaucaaaagauaauaacgauuggcucuguuucucucaccauuuccacaauaugcuucuucaugcaaauugccaucuugauaacuaccguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguuaacaaaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53474 - RNA, 1410 nt, Artificial Sequence
  neuraminidase__InfluenzaA__AFN19472
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucuggguaacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53475 - RNA, 1410 nt, Artificial Sequence
  neuraminidase__InfluenzaA__AFN19476
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuuaucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53476 - RNA, 1410 nt, Artificial Sequence
  neuraminidase__InfluenzaA__AFN19478
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaaugggacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53477 - RNA, 1410 nt, Artificial Sequence
  neuraminidase__InfluenzaA__AFN19480
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguaggugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauaguauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaagugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcacaucagguacauauggaacaggcucauggccugauggggcggaccucaaucucaugccuauauaa

SEQ ID NO: 53478 - RNA, 1410 nt, Artificial Sequence
  neuraminidase__InfluenzaA__AFN19482
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcaaaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53479 - RNA, 1410 nt, Artificial Sequence; identical to SEQ ID NO: 53472
  neuraminidase__InfluenzaA__AFN19484

SEQ ID NO: 53480 - RNA, 1410 nt, Artificial Sequence
  neuraminidase__InfluenzaA__AFN19488
augaauccaaaucaaaagauaauaacgauuggcucuguuucucucaccauuucaacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuuaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucuggguaacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53481 - RNA, 1410 nt, Artificial Sequence
  neuraminidase__InfluenzaA__AFN19492
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53482 - RNA, 1410 nt, Artificial Sequence
  neuraminidase__InfluenzaA__AFN19494
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauugucguguuuuguggcaccucagguacauauggaacaggcucauggccugauggggcggaccucaaucucaugccuauauaa

SEQ ID NO: 53483 - RNA, 1410 nt, Artificial Sequence; identical to SEQ ID NO: 52303
  neuraminidase__InfluenzaA__AFN19496

SEQ ID NO: 53484 - RNA, 1410 nt, Artificial Sequence
  neuraminidase__InfluenzaA__AFN19498
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacuccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaacagaggaaacugaagucuuguggaccucaaacaguauuguuguguuuuguggcaccucagguacauauggaacaggcucauggccugauggggcggaccucaaucucaugccuauauaa

SEQ ID NO: 53485 - RNA, 1410 nt, Artificial Sequence; identical to SEQ ID NO: 53438
  neuraminidase__InfluenzaA__AFN19500

SEQ ID NO: 53486 - RNA, 1410 nt, Artificial Sequence
  neuraminidase__InfluenzaA__AFN19502
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucagaacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacgcccagaaaaaacgacagcuccagcaguagccauuguuuggauccuaacaaugaagaagguggucauggagugaaaggcugggccuuugaugauggaaaugacguuuggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53487 - RNA, 1410 nt, Artificial Sequence
  neuraminidase__InfluenzaA__AFN19504
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagaaauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaagauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacaucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53488 - RNA, 1410 nt, Artificial Sequence; identical to SEQ ID NO: 53487
  neuraminidase__InfluenzaA__AFN19506

SEQ ID NO: 53489 - RNA, 1410 nt, Artificial Sequence; identical to SEQ ID NO: 53438
  neuraminidase__InfluenzaA__AFN19508

SEQ ID NO: 53490 - RNA, 1410 nt, Artificial Sequence; identical to SEQ ID NO: 53433
  neuraminidase__InfluenzaA__AFN19510

SEQ ID NO: 53491 - RNA, 1410 nt, Artificial Sequence; identical to SEQ ID NO: 53486
  neuraminidase__InfluenzaA__AFN19512

SEQ ID NO: 53492 - RNA, 1410 nt, Artificial Sequence
  neuraminidase__InfluenzaA__AFN19516
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacgcccagaaaaaacgacagcuccagcaguagccauuguuuggauccuaacaaugaagaagguggucauggagugaaaggcugggcauuugaugauggaaaugacguuuggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53493 - RNA, 1410 nt, Artificial Sequence; identical to SEQ ID NO: 53438
  neuraminidase__InfluenzaA__AFN19518

SEQ ID NO: 53494 - RNA, 1410 nt, Artificial Sequence; identical to SEQ ID NO: 53438
  neuraminidase__InfluenzaA__AFN19520

SEQ ID NO: 53495 - RNA, 1410 nt, Artificial Sequence; identical to SEQ ID NO: 53429
  neuraminidase__InfluenzaA__AFN19522

SEQ ID NO: 53496 - RNA, 1410 nt, Artificial Sequence
  neuraminidase__InfluenzaA__AFN19524
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacgcccagaaaaaacgacagcuccagcaguagccauuguuuggauccuaacaaugaagaagguggucauggagugaaaggcugggcauuugaugauggaaaugacguuuggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucagucucaugccuauauaa

SEQ ID NO: 53497 - RNA, 1410 nt, Artificial Sequence
  neuraminidase__InfluenzaA__AFN19526
augaauccaaaucaaaagauaauaacgauuggcucuguuucucucaccauuuccacaauaugcuucuuuaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccacagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaccgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53498 - RNA, 1410 nt, Artificial Sequence
  neuraminidase__InfluenzaA__AFN19528
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaaucugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53499 - RNA, 1410 nt, Artificial Sequence; identical to SEQ ID NO: 53462
  neuraminidase__InfluenzaA__AFN19530

SEQ ID NO: 53500 - RNA, 1410 nt, Artificial Sequence; identical to SEQ ID NO: 53429
  neuraminidase__InfluenzaA__AFN19532

SEQ ID NO: 53501 - RNA, 1410 nt, Artificial Sequence
  neuraminidase__InfluenzaA__AFN19534
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcacucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53502 - RNA, 1410 nt, Artificial Sequence
  neuraminidase__InfluenzaA__AFN19536
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugcccaaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53503 - RNA, 1410 nt, Artificial Sequence; identical to SEQ ID NO: 53448
  neuraminidase__InfluenzaA__AFN19538

SEQ ID NO: 53504 - RNA, 1410 nt, Artificial Sequence
  neuraminidase__InfluenzaA__AFN19544
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53505 - RNA, 1410 nt, Artificial Sequence
  neuraminidase__InfluenzaA__AFN19546
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugagugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucgugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53506 - RNA, 1410 nt, Artificial Sequence
  neuraminidase__InfluenzaA__AFN19548
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucuggguaacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuucagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53507 - RNA, 1410 nt, Artificial Sequence
  neuraminidase__InfluenzaA__AFN19550
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccucaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucauucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaaugacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcauaaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53508 - RNA, 1410 nt, Artificial Sequence; identical to SEQ ID NO: 53502
  neuraminidase__InfluenzaA__AFN19552

SEQ ID NO: 53509 - RNA, 1410 nt, Artificial Sequence; identical to SEQ ID NO: 53466
  neuraminidase__InfluenzaA__AFN19554

SEQ ID NO: 53510 - RNA, 1410 nt, Artificial Sequence; identical to SEQ ID NO: 53472
  neuraminidase__InfluenzaA__AFN19556

SEQ ID NO: 53511 - RNA, 1410 nt, Artificial Sequence
  neuraminidase__InfluenzaA__AFN19558
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagaugaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53512 - RNA, 1410 nt, Artificial Sequence
  neuraminidase__InfluenzaA__AFN19560
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggcuuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaaggagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53513 - RNA, 1410 nt, Artificial Sequence
  neuraminidase__InfluenzaA__AFN19562
augaauccaaaucaaaagauaauaacgauuggcucuguuucucucaccauuuccacaauaugcuucuucaugcaaauugccaucuugauaacuaccguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguuaacaaaagugauagguccgguuauucugguauuuucucuguugaaggcaaaaguugcaucaaucggugcuuuuauguggaguugauuaggggaagaaaagaggaaacugaaguauuguggaccucaaacaguauuguuguguuuuguggcaccucagguacauauggaacaggcucauggccugauggggcggaccucaaucucaugccuauauaa

SEQ ID NO: 53514 - RNA, 1410 nt, Artificial Sequence
  neuraminidase__InfluenzaA__AFN19564
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaccgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53515 - RNA, 1410 nt, Artificial Sequence
  neuraminidase__InfluenzaA__AFN19566
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaugaaauucucaggacccaggagucagaauguguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaauaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugagggcaaaagcugcaucaaucggugcuuuuauguggaguugauuaggggaagaaaagaggaaaaugaagucuuguggaccucaaacaguauuguuguguuuuguggcaccucagguacauauggaacaggcucauggccugauggggcggaccucaaucucaugccuauauaa

SEQ ID NO: 53516 - RNA, 1410 nt, Artificial Sequence
  neuraminidase__InfluenzaA__AFN19568
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagguaaauaggcaagucauaguugacagaggugauagguccgguuauucugguauuuucucuguugaaggcaaaagcugcaucaaucggugcuuuuauguggaguugauuaggggaagaaaagaggaaauugaagucuuguggaccucaaacaguauuguuguguuuuguggcaccucagguacauauggaacaggcucauggccugauggggcggaccucaaucucaugccuauauaa

SEQ ID NO: 53517 - RNA, 1410 nt, Artificial Sequence
  neuraminidase__InfluenzaA__AFN19570
augaauccaaaucaaaagauaauaacgauuggcucuguuucucucaccauuuccacaauaugcuucuucaugcaaauugccaucuugauaacuacuguaacauugcauuucaagcaauaugaauucaacuaccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaugaaauucucaggacccaggagucagaauguguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaauaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugagggcaaaagcugcaucaaucggugcuuuuauguggaguugauuaggggaagaaaagaggaaaaugaagucuuguggaccucaaacaguauuguuguguuuuguggcaccucagguacauauggaacaggcucauggccugauggggcggaccucaaucucaugccuauauaa

SEQ ID NO: 53518 - RNA, 1410 nt, Artificial Sequence
  neuraminidase__InfluenzaA__AFN19572
augaauccaaaucaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggauuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguuuguucaggacuuguuggagacacacccagaaaaaacgacagcuccagcaguagccauuguuuggauccuaauaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53519 - RNA, 1410 nt, Artificial Sequence
  neuraminidase__InfluenzaA__AFN19574
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuugggcaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaaaaaauccucagaacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggccauggagugaaaggcugggccuuugaugauggaaaugacguguggaugggaaggacgaucagcgagaagucacgcuuaggguaugaaaccuucaaagucauugaaggcugguccaacccuaaguccaaauugcagauaaauagacaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 53520 - RNA, 1410 nt, Artificial Sequence
  neuraminidase__InfluenzaA__AFN19576
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugauggaaaugacguguggaugggaagaacaaucaacgagacgucacgauuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53521 - RNA, 1410 nt, Artificial Sequence; identical to SEQ ID NO: 53433
  neuraminidase__InfluenzaA__AFN19578

SEQ ID NO: 53522 - RNA, 1410 nt, Artificial Sequence; identical to SEQ ID NO: 53433
  neuraminidase__InfluenzaA__AFN19582

SEQ ID NO: 53523 - RNA, 1410 nt, Artificial Sequence; identical to SEQ ID NO: 53433
  neuraminidase__InfluenzaA__AFN19584

SEQ ID NO: 53524 - RNA, 1410 nt, Artificial Sequence
  neuraminidase__InfluenzaA__AFN19588
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacgcccagaaaaaacgacagcuccagcaguagccauuguuuggauccuaacaaugaagaagguggucauggagugaaaggcugggccuuugaugauggaaaugacguuuggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucuaaugccuauauaa

SEQ ID NO: 53525 - RNA, 1410 nt, Artificial Sequence; identical to SEQ ID NO: 53433
  neuraminidase__InfluenzaA__AFN19590

SEQ ID NO: 53526 - RNA, 1410 nt, Artificial Sequence; identical to SEQ ID NO: 53462
  neuraminidase__InfluenzaA__AFN19592

SEQ ID NO: 53527 - RNA, 1410 nt, Artificial Sequence; identical to SEQ ID NO: 53433
  neuraminidase__InfluenzaA__AFN19594

SEQ ID NO: 53528 - RNA, 1410 nt, Artificial Sequence; identical to SEQ ID NO: 53438
  neuraminidase__InfluenzaA__AFN19596

SEQ ID NO: 53529 - RNA, 1410 nt, Artificial Sequence; identical to SEQ ID NO: 53438
  neuraminidase__InfluenzaA__AFN19600

SEQ ID NO: 53530 - RNA, 1410 nt, Artificial Sequence
  neuraminidase__InfluenzaA__AFN19602
augaauccaaaucaaaagauaauaacgauuggcucuguuucucucacccuuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53531 - RNA, 1410 nt, Artificial Sequence; identical to SEQ ID NO: 53433
  neuraminidase__InfluenzaA__AFN19604

SEQ ID NO: 53532 - RNA, 1410 nt, Artificial Sequence
  neuraminidase__InfluenzaA__AFN19606
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacuacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacgcccagaaaaaacgacagcuccagcaguagccauuguuuggauccuaacaaugaagaagguggucauggagugaaaggcugggccuuugaugauggaaaugacguuuggaugggaagaacaaucaacgagacaucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53533 - RNA, 1410 nt, Artificial Sequence; identical to SEQ ID NO: 53429
  neuraminidase__InfluenzaA__AFN19608

SEQ ID NO: 53534 - RNA, 1410 nt, Artificial Sequence
  neuraminidase__InfluenzaA__AFN19610
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53535 - RNA, 1410 nt, Artificial Sequence; identical to SEQ ID NO: 53438
  neuraminidase__InfluenzaA__AFN19612

SEQ ID NO: 53536 - RNA, 1410 nt, Artificial Sequence
  neuraminidase__InfluenzaA__AFN19614
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53537 - RNA, 1410 nt, Artificial Sequence
  neuraminidase__InfluenzaA__AFN19618
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaugaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaauaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugagggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53538 - RNA, 1410 nt, Artificial Sequence; identical to SEQ ID NO: 53429
  neuraminidase__InfluenzaA__AFN19620

SEQ ID NO: 53539 - RNA, 1410 nt, Artificial Sequence; identical to SEQ ID NO: 53462
  neuraminidase__InfluenzaA__AFN19624

SEQ ID NO: 53540 - RNA, 1410 nt, Artificial Sequence; identical to SEQ ID NO: 53433
  neuraminidase__InfluenzaA__AFN19630

SEQ ID NO: 53541 - RNA, 1410 nt, Artificial Sequence
  neuraminidase__InfluenzaA__AFN19632
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccaacagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacugaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguuuguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53542 - RNA, 1410 nt, Artificial Sequence
  neuraminidase__InfluenzaA__AFN19634
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuagacuuuccgcugguggggacaucugggugacaagagaaccuuaugugucaugcgauccugacaaguguuaucaauuugcccuuggacagggaacaacacuaaacaaugugcauucaaauaacacaguacgugauaggaccucuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguuuguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53543 - RNA, 1410 nt, Artificial Sequence
  neuraminidase__InfluenzaA__AFN19636
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaucauagagaaggaaauaugccccaaaccaacagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguuuguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53544 - RNA, 1410 nt, Artificial Sequence
  neuraminidase__InfluenzaA__AFN19638
augaauccaaaucaaaagauaauaacgauuggcucuguuucucuaaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaucauagagaaggaaauaugccccaaaccaacagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguuuguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53545 - RNA, 1410 nt, Artificial Sequence
  neuraminidase__InfluenzaA__AFN19640
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccggcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaacgcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53546 - RNA, 1410 nt, Artificial Sequence
  neuraminidase__InfluenzaA__AFN19642
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguaagugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53547 - RNA, 1410 nt, Artificial Sequence; identical to SEQ ID NO: 53543
  neuraminidase__InfluenzaA__AFN19644

SEQ ID NO: 53548 - RNA, 1410 nt, Artificial Sequence
  neuraminidase__InfluenzaA__AFN19646
augaauccaaaucaaaagauaauaacgauuggcucuguuucucucaccauuuccacaauaugcuucuucauacaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguuaacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53549 - RNA, 1410 nt, Artificial Sequence
  neuraminidase__InfluenzaA__AFN19648
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuuccaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggacuaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccugguguaagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguuuggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53550 - RNA, 1410 nt, Artificial Sequence; identical to SEQ ID NO: 53462
  neuraminidase__InfluenzaA__AFN19650

SEQ ID NO: 53551 - RNA, 1410 nt, Artificial Sequence
  neuraminidase__InfluenzaA__AFN19652
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagguaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53552 - RNA, 1410 nt, Artificial Sequence
  neuraminidase__InfluenzaA__AFN19654
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaacaugccccaaaccaacagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagagauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguuuguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53553 - RNA, 1410 nt, Artificial Sequence
  neuraminidase__InfluenzaA__AFN19656
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucagaacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53554 - RNA, 1410 nt, Artificial Sequence; identical to SEQ ID NO: 53466
  neuraminidase__InfluenzaA__AFN19658

SEQ ID NO: 53555 - RNA, 1410 nt, Artificial Sequence; identical to SEQ ID NO: 53544
  neuraminidase__InfluenzaA__AFN19660

SEQ ID NO: 53556 - RNA, 1410 nt, Artificial Sequence; identical to SEQ ID NO: 53466
  neuraminidase__InfluenzaA__AFN19662

SEQ ID NO: 53557 - RNA, 1410 nt, Artificial Sequence
  neuraminidase__InfluenzaA__AFN19664
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaacaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53558 - RNA, 1410 nt, Artificial Sequence
  neuraminidase__InfluenzaA__AFN19666
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguuaacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcacuucagguacauauggaacaggcucauggccugauggggcggaccucaaucucaugccuauauaa

SEQ ID NO: 53559 - RNA, 1410 nt, Artificial Sequence
  neuraminidase__InfluenzaA__AFN19668
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgagcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53560 - RNA, 1410 nt, Artificial Sequence
  neuraminidase__InfluenzaA__AFN19670
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacgauaauagaaagaaacaugacagagauaguguaucugaccaacaccaccauagagaaggaaauaugccccaaaccagcagaauacagaaauuggucaaaaccgcaaugugacauuacaggauuugcaccuuuuucgaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggauggguagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53561 - RNA, 1410 nt, Artificial Sequence; identical to SEQ ID NO: 53466
  neuraminidase__InfluenzaA__AFN19673

SEQ ID NO: 53562 - RNA, 1410 nt, Artificial Sequence
  neuraminidase__InfluenzaA__AFN19675
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggacuccuuaucggacuuuauugaugaaugaguuagguguuccuuuucaucugggaaccaagcaagugugcauagcauggucuagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53563 - RNA, 1410 nt, Artificial Sequence
  neuraminidase__InfluenzaA__AFN19677
augaauccaaaucaaaagauaauaacgauuggcucuguuucucucaccauuuccauaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucuggguaacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgaugggaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53564 - RNA, 1410 nt, Artificial Sequence
  neuraminidase__InfluenzaA__AFN19683
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacgauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggauggguagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53565 - RNA, 1410 nt, Artificial Sequence; identical to SEQ ID NO: 53429
  neuraminidase__InfluenzaA__AFN19685

SEQ ID NO: 53566 - RNA, 1410 nt, Artificial Sequence
  neuraminidase__InfluenzaA__AFN19687
augaauccaaaucaaaagauaauaacgauuggaucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaauguguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaaguuuuguggaccucaaacaguauuguuguguuuuguggcaccucagguacauauggaacaggcucauggccugauggggcggaccucaaucucaugccuauauaa

SEQ ID NO: 53567 - RNA, 1410 nt, Artificial Sequence; identical to SEQ ID NO: 53474
  neuraminidase__InfluenzaA__AFN19689

SEQ ID NO: 53568 - RNA, 1410 nt, Artificial Sequence; identical to SEQ ID NO: 53466
  neuraminidase__InfluenzaA__AFN19691

SEQ ID NO: 53569 - RNA, 1410 nt, Artificial Sequence
  neuraminidase__InfluenzaA__AFN19693
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguucccuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuugugcuguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaagggcuccaauaggcccaucguagauauaaacauaaaggaucauagcauuguuuccaguuauguguguucaggacuuguuggagacacacccagaaaaaacgacagcuccagcaguagcaauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagaacugcaucaaucggugcuuuuauguggaguugauuaggggaagaaaagaggaaacugaagucuuauggaccucaaacaguauuguuguguuuuguggcaccucagguacauauggaacaggcucauggccugauggggcggaccucaaucucaugccuauauaa

SEQ ID NO: 53570 - RNA, 1410 nt, Artificial Sequence
  neuraminidase__InfluenzaA__AFN19697
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaacucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacaggggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53571 - RNA, 1410 nt, Artificial Sequence
  neuraminidase__InfluenzaA__AFN19699
augaauccaaaucaaaagauaauaacgauuggcucuguuucucucaccauuuccacaauaugcuucuucaugcaaauugccaucuugauaacuacuguaacacugcauuucaagcaauaugaauucaacucccccccaaacaaccaagugaugcugugugaaccaacaauaauagaaagaaacauaacagaaauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53572 - RNA, 1410 nt, Artificial Sequence
  neuraminidase__InfluenzaA__AFN19701
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaagugacagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53573 - RNA, 1410 nt, Artificial Sequence
  neuraminidase__InfluenzaA__AFN19703
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuagacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53574 - RNA, 1410 nt, Artificial Sequence
  neuraminidase__InfluenzaA__AFN19711
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53575 - RNA, 1410 nt, Artificial Sequence
  neuraminidase__InfluenzaA__AFN19721
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccauggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53576 - RNA, 1410 nt, Artificial Sequence
  neuraminidase__InfluenzaA__AFN19731
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuuuuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53577 - RNA, 1410 nt, Artificial Sequence; identical to SEQ ID NO: 53574
  neuraminidase__InfluenzaA__AFN19737

SEQ ID NO: 53578 - RNA, 1410 nt, Artificial Sequence
  neuraminidase__InfluenzaA__AFN19747
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacucaugaaaacaacacuuggguaaaucagacauauguuaacaucagcaacaccaacuuugcugcuggacaaucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggacaacuggcauggcgcgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53579 - RNA, 1410 nt, Artificial Sequence
  neuraminidase__InfluenzaA__AFN19749
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugaggacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53580 - RNA, 1410 nt, Artificial Sequence
  neuraminidase__InfluenzaA__AFN19759
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugauaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53581 - RNA, 1410 nt, Artificial Sequence
  neuraminidase__InfluenzaA__AFN19769
augaauccaaaccaaaagauaauaaccauugguucggucuguaugacaauuggaauggcuaaccuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauagggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53582 - RNA, 1410 nt, Artificial Sequence; identical to SEQ ID NO: 53574
  neuraminidase__InfluenzaA__AFN19783

SEQ ID NO: 53583 - RNA, 1410 nt, Artificial Sequence
  neuraminidase__InfluenzaA__AFN19793
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacaaucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggacaacuggcauggcgcgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53584 - RNA, 1410 nt, Artificial Sequence; identical to SEQ ID NO: 53574
  neuraminidase__InfluenzaA__AFN19807

SEQ ID NO: 53585 - RNA, 1410 nt, Artificial Sequence
  neuraminidase__InfluenzaA__AFN19809
augaauccaaaccaaaagauaauaaccauugguucggucuguaugauaauuggaauggcuaacuuaauguuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugauuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcauggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucaacuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53586 - RNA, 1410 nt, Artificial Sequence
  neuraminidase__InfluenzaA__AFN19815
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucgagaaaagguuuugagaugauuugggauccaaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaauuaa

SEQ ID NO: 53587 - RNA, 1410 nt, Artificial Sequence
  neuraminidase__InfluenzaA__AFN19833
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaauaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaaaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53588 - RNA, 1410 nt, Artificial Sequence; identical to SEQ ID NO: 51220
  neuraminidase__InfluenzaA__AFN19851

SEQ ID NO: 53589 - RNA, 1410 nt, Artificial Sequence
  neuraminidase__InfluenzaA__AFN19857
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53590 - RNA, 1410 nt, Artificial Sequence
  neuraminidase__InfluenzaA__AFN19867
augaauccaaaccaaaagauaauaaccauugguucggucuguaugacaauuggaauggcuaacuuaauauuacaaauuggaaacauaaucucaauauggauuagccacucaauucaaaucgggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccugucaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaaugguucuugcuuuaccauaauaaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53591 - RNA, 1410 nt, Artificial Sequence
  neuraminidase__InfluenzaA__AFN19877
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacguccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauauaguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53592 - RNA, 1410 nt, Artificial Sequence
  neuraminidase__InfluenzaA__AFN19887
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggacccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuacuauugacaaguaa

SEQ ID NO: 53593 - RNA, 1410 nt, Artificial Sequence
  neuraminidase__InfluenzaA__AFN19897
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggccauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccaugcaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53594 - RNA, 1410 nt, Artificial Sequence; identical to SEQ ID NO: 53592
  neuraminidase__InfluenzaA__AFN19907

SEQ ID NO: 53595 - RNA, 1410 nt, Artificial Sequence; identical to SEQ ID NO: 51220
  neuraminidase__InfluenzaA__AFN19917

SEQ ID NO: 53596 - RNA, 1410 nt, Artificial Sequence
  neuraminidase__InfluenzaA__AFN19923
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaaacgucauuacuuaugaaaacaacacuuggguaaaucagacauauguuaacaucagcaacaccaacuuugcugcuggacagucagugguuuccgugaaauuagcgggcaauuccucucucugcccuguuagcggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaaaaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuuccuucaaccagaaucuggaauaucagauaggauacauaugcagugggauuuucggagacaauccacgcccuaacgauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53597 - RNA, 1410 nt, Artificial Sequence
  neuraminidase__InfluenzaA__AFN19933
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaauagugacacuguggguuggucuuggccagacggugcugaguugccauuuaccauugacaaguaa

SEQ ID NO: 53598 - RNA, 1410 nt, Artificial Sequence
  neuraminidase__InfluenzaA__AFN19943
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauaacuuaugaaaacaacacuuggguaaaucagacauauguuaacaucagcaacaccaacuuugcugcuggacaaucagugguuuccgugaaauuagcgggcaauucuucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaauggcucuugcuuuacugugaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcgcgaaucgaccgugggugucuuucaaccagaaucuggaauaucagauaggauacauaugcagugggauuuucggggacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53599 - RNA, 1410 nt, Artificial Sequence
  neuraminidase__InfluenzaA__AFN19953
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagagucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggauccaaacggauggacugggacagacaauaacuucucaauaaagcaagauaucguagaaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53600 - RNA, 1410 nt, Artificial Sequence
  neuraminidase__InfluenzaA__AFN19967
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaagcaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53601 - RNA, 1410 nt, Artificial Sequence
  neuraminidase__InfluenzaA__AFN19973
augaauccaaaccaaaagauaauaaccauugguucggucuguaugacaauuggaauggcuaacuuaauauuacagauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaucaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggaucccaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53602 - RNA, 1410 nt, Artificial Sequence
  neuraminidase__InfluenzaA__AFN19979
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucauuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53603 - RNA, 1410 nt, Artificial Sequence
  neuraminidase__InfluenzaA__AFN19985
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcguuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53604 - RNA, 1410 nt, Artificial Sequence
  neuraminidase__InfluenzaA__AFN19995
augaauccaaaccaaaagauaauaaccauugguucggucuguaugacaauuggaauggcuaacuuaauauuacaaauuggaaacauaaucucaauauggauuagccacucaauucaacuugggaaucaaagucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauugcauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 53605 - RNA, 1410 nt, Artificial Sequence; identical to SEQ ID NO: 51226
  neuraminidase__InfluenzaA__AFN20001

SEQ ID NO: 53606 - RNA, 1410 nt, Artificial Sequence
  neuraminidase__InfluenzaA__AFN20013
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccugcuaaaugacaaacauuccaauggaaccauuaaagacaggagcccauaucgaaccuuaaugagcuguccuauuggugaaguucccucuccauacaacucaagauuugagucagucgcuuggucagcaagugccugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugauccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53607 - RNA, 1410 nt, Artificial Sequence
  neuraminidase__InfluenzaA__AFN20020
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccgagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggacuaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53608 - RNA, 1410 nt, Artificial Sequence
  neuraminidase__InfluenzaA__AFN20022
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53609 - RNA, 1410 nt, Artificial Sequence
  neuraminidase__InfluenzaA__AFN20035
augaauccaaaccaaaagauaauaaccauugguucggucuguaugacaauuggaaucgcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53610 - RNA, 1410 nt, Artificial Sequence; identical to SEQ ID NO: 53574
  neuraminidase__InfluenzaA__AFN20041

SEQ ID NO: 53611 - RNA, 1410 nt, Artificial Sequence; identical to SEQ ID NO: 53589
  neuraminidase__InfluenzaA__AFN20047

SEQ ID NO: 53612 - RNA, 1410 nt, Artificial Sequence; identical to SEQ ID NO: 53586
  neuraminidase__InfluenzaA__AFN20063

SEQ ID NO: 53613 - RNA, 1410 nt, Artificial Sequence
  neuraminidase__InfluenzaA__AFN20077
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugaugggcaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53614 - RNA, 1410 nt, Artificial Sequence
  neuraminidase__InfluenzaA__AFN20083
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaauacuuggguaaaucagacauauguuaacaucagcaacaccaacuuugcugcuggacagucagugguuuccgugaaauuagcgggcaauuccucucucugcccuguuaguggaugggccauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53615 - RNA, 1410 nt, Artificial Sequence
  neuraminidase__InfluenzaA__AFN20094
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuauuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuuuggagacaauccacgcccuaaugauaaggcaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuauggguuggucuuggccagacggugcugaguugccauuuaccauugacaaguaa

SEQ ID NO: 53616 - RNA, 1410 nt, Artificial Sequence; identical to SEQ ID NO: 53598
  neuraminidase__InfluenzaA__AFN20100

SEQ ID NO: 53617 - RNA, 1410 nt, Artificial Sequence
  neuraminidase__InfluenzaA__AFN20114
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucuguccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacagaagcccauaucgaacccuaaugagcuguccuauuggugaaguuccuucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgagaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguuguaguccaguaucgucuaauggagcaaauggaguaaaaggauuuucauucaaauacggcaaugguguuuggauagggagaacuaaaagcacuaguucaagaaacgguuuugagaugauuugggauccgaacggauggacugggacagacaauagcuucucaaugaagcaagauaucguaggaauaaaugaguggucaggauauagcgggaguuuuguucagcauccagaacuaacagggcuggauuguauaagaccuugcuucuggguugaacuaaucagagggcgaccuaaagagaacacagucuggacuagcgggagcagcauauccuuuugcgguguaaacagugacacuguggguuggucuuggccagacggugcugaguugccauuuaccauugacaaguaa

SEQ ID NO: 53618 - RNA, 1410 nt, Artificial Sequence
  neuraminidase__InfluenzaA__AFN20128
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaggaguuggagaaacaauauauugagaacacaagagucugaaugugcauguguaaaugguucuugcuuuaccauaaugaccgauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcucuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaauagugacacuguggguuggucuuggccagacggugcugaguugccauuuaccauugacaaguaa

SEQ ID NO: 53619 - RNA, 1410 nt, Artificial Sequence
  neuraminidase__InfluenzaA__AFN87935
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugaggacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53620 - RNA, 1410 nt, Artificial Sequence
  neuraminidase__InfluenzaA__AFN87937
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaauaucagcaacaccaacuuugcugcuggacagucagugguuuccgugaaauuagcgggcaauuccucucucuguccuguuaguggaugggcuauauacaguaaagacaacaguauaagaaucgguuccaagggggauguguuugucauaagggaaccauucauaucaugcucucccuuggaaugcagaaccuucuucuugacucaaggggccuugcuaaaugacaaacauuccaauggaaccauuaaagacagaagcccauaucgaacccuaaugagcuguccuauuggugaaguuccuucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgagaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcacuaguucaagaaaugguuuugagaugauuugggauccgaacggauggacugggacagacaauagcuucucaaugaagcaagauaucguaggaauaaaugaguggucaggauauagcgggaguuuuguucagcauccagaacuaacagggcuggauuguauaagaccuugcuucuggguugaacuaaucagagggcgaccuaaagagaacacagucuggacuagcgggagcagcauauccuuuugcgguguaaacagugacacuguggguuggucuuggccagacggugcugaguugccauuuaccauugacaaguaa

SEQ ID NO: 53621 - RNA, 1410 nt, Artificial Sequence
  neuraminidase__InfluenzaA__AFN87940
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacagaagcccauaucgaacccuaaugagcuguccuauuggugaaguuccuucuccauacaacucgagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgagaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcacuaguucaagaaacgguuuugagaugauuugggauccaaacggauggacugggacagacaauagcuucucaauaaagcaagauaucguaggaauaaaugaguggucaggauauagcgggaguuuuguucagcauccagaacuaacagggcuggauuguauaagaccuugcuucuggguugaacuaaucagagggcgaccuaaagagaacacaaucuggacuagcgggagcagcauauccuuuugcgguguaaacagugacacuguggguuggucuuggccagacggugcugaguugccauuuaccauugacaaguaa

SEQ ID NO: 53622 - RNA, 1410 nt, Artificial Sequence
  neuraminidase__InfluenzaA__AFN87942
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggaaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgccccaaugauaagacaggaaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagugggaguuuuguacagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53623 - RNA, 1410 nt, Artificial Sequence
  neuraminidase__InfluenzaA__AFN87944
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaauaucagcaacaccaacuuugcugcuggacagucagugguuuccgugaaauuagcgggcaauuccucucucuguccuguuaguggaugggcuauauacaguaaagacaacaguauaagaaucgguuccaagggggauguguuugucauaagggaaccauucauaucaugcucucccuuggaaugcagaaccuucuucuugacucaaggggccuugcuaaaugacaaacauuccaauggaaccauuaaagacagaagcccauaucgaacccuaaugagcuguccuauuggugaaguuccuucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgagaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaauggugucuggauagggagaacuaaaagcacuaguucaagaaaugguuuugagaugauuugggauccgaacggauggacugggacagacaauagcuucucaaugaagcaagauaucguaggaauaaaugaguggucaggauauagcgggaguuuuguucagcauccagaacuaacagggcuggauuguauaagaccuugcuucuggguugaacuaaucagagggcgaccuaaagagaacacagucuggacuagcgggagcagcauauccuuuugcgguguaaacagugacacuguggguuggucuuggccagacggugcugaguugccauuuaccauugacaaguaa

SEQ ID NO: 53624 - RNA, 1410 nt, Artificial Sequence
  neuraminidase__InfluenzaA__AFN87946
augaauccaaaccaaaagauaauaaccauugguucggucuguaugacaauuggaauggcuaacuuaacauuacaaauuggaaacauaaucucaauauggauuagccacucaauucaacuugggaaucaaaaucagauugaaaccugcaaucaaagcgucauuaauuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucguaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauauaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugaggacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaagucacaugugugugcagggauaacuggcauggcucaaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggugucuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacaggacuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53625 - RNA, 1410 nt, Artificial Sequence
  neuraminidase__InfluenzaA__AFN87948
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggagugcagaaccuucuucuugacucaaggggccuugcuaaaugacaaacauuccaauggaaccauuaaagacagaagcccauaucgaacccuaaugagcuguccuauuggugaaguuccuucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgagaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaauggugucuggauagggagaacuaaaagcacuaguucaagaaacgguuuugagaugauuugggauccgaacggauggacugggacagacaauagcuucucaauaaagcaagauaucguaggaauaaaugaguggucaggauauagcgggaguuuuguucagcauccagaacuaacagggcuggauuguauaagaccuugcuucuggguugaacuaaucagagggcgaccuaaagagaacacaaucuggacuagcgggagcagcauauccuuuugcgguguaaacagugacauuguggguuggucuuggccagacggugcugaguugccauuuaccauugacaaguaa

SEQ ID NO: 53626 - RNA, 1410 nt, Artificial Sequence
  neuraminidase__InfluenzaA__AFN87950
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucguacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgacggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucugaaauaucagauaggauacauaugcagugggauuuucggggacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53627 - RNA, 1410 nt, Artificial Sequence; identical to SEQ ID NO: 51309
  neuraminidase__InfluenzaA__AFN87952

SEQ ID NO: 53628 - RNA, 1410 nt, Artificial Sequence
  neuraminidase__InfluenzaA__AFN87954
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggaguccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagauacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguuugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaacggauggacugggacagacaauaauuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuauggguuggucuuggccagacggugcugaguugccauuuaccauugacaaguaa

SEQ ID NO: 53629 - RNA, 1410 nt, Artificial Sequence
  neuraminidase__InfluenzaA__AFN87956
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaacuauuaaagacagaagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagacaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaauuaa

SEQ ID NO: 53630 - RNA, 1410 nt, Artificial Sequence
  neuraminidase__InfluenzaA__AFN87958
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaauaucagcaacaccaacuuugcugcuggacagucagugguuuccgugaaauuagcgggcaauuccucucucuguccuguuaguggaugggcuauauacaguaaagacaacaguauaagaaucgguuccaagggggauguguuugucauaagggaaccauucauaucaugcucucccuuggaaugcagaaccuucuucuugacucaaggggccuugcuaaaugacaaacauuccaauggaaccauuaaagacagaagcccauaucgaacccuaaugagcuguccuauuggugaaguuccuucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgacggaccaagugauggacaggccucauacaagaucuucaaaauagaaaagggaaagauagucaaaucagucgagaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccagcaucgucuaauggagcaaauggaguaaaaggauuuucauucaaauacggcaaugguguuuggauagggagaacuaaaagcacuaguucaagaaaugguuuugagaugauuugggauccgaacggauggacugggacagacaauagcuucucaaugaagcaagauaucguaggaauaaaugaguggucaggauauagcgggaguuuuguucagcauccagaacuaacagggcuggauuguauaaggccuugcuucuggguugaacuaaucagagggcgaccuaaagagaacacagucuggacuagcgggagcagcauauccuuuugcgguguaaacagugacacuguggguuggucuuggccagacggugcugaguugccauuuaccauugacaaguaa

SEQ ID NO: 53631 - RNA, 1410 nt, Artificial Sequence
  neuraminidase__InfluenzaA__AFN87960
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccaaaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggauugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53632 - RNA, 1413 nt, Artificial Sequence
  neuraminidase__InfluenzaA__AFO64805
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauauaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcgaauauuaagaacacaagagucugaaugugucugugugaacgggucauguuuuaccauaaugaccgauggcccgaauaauggggccgccucguacaaaaucuucaagaucgaaaaggggaagguuacuaaaucaauagaguugaaugcacccaauucucauuaugaggaauguuccuguuacccagacacuggcacagugauguguguaugcagagacaacuggcacgguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggauuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccauucaccauugacaaguag

SEQ ID NO: 53633 - RNA, 1413 nt, Artificial Sequence
  neuraminidase__InfluenzaA__AFO64816
augaauccaaaucagaaaauaauaaccauaggaucaaucuguauggcaauaggaauaauuagucuaauauugcaaauaggaaauauuguuucaauauggaucagccacucaauccaaacuggaagucaaaacuacacuggaauaugcaaccaaagaaucauuaccuaugaaaauagcaccuggguaaaucaaacauauguuaauaucaacaacacuaauguuguugcuggacaggacacaacuucaguggcauuagccggcaauucaucucuuuguccuaucagugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaauggaaccguuaaggacagaagcccuuauagggccuuaaugagcuguccuauaggugaagcuccgucucccuacaauucaagguuugaaucaguugcuuggucagcaagcgcaugucaugauggcaugggcuggcuaacaaucggaauuucugguccagaugauggagcaguggcuguacuaaaauacaacgguauaauaacugaaaccauaaaaaguuggaggaggcgaauauuaagaacacaagagucugaaugugucuguguaaacgguucauguuuuaccauaaugaccgauggcccgaauaaugggccugccucguacaaaaucuucaaaaucgagaaggggaagguuacuaaaucaauagaguuggaugcacccaauucucauuacgaggaauguuccuguuacccagacgccggcacagugaugugugugugcagagacaauuggcaugguucgaaucgaccuugggugucuuuuaaucaaaaccuggauuaucaaauaggauacaucugcagugguguuuuuggugacaauccgcgucccaaagauggaaaaggcagcugugauccaguaacuguugauggagcagacggaguaaagggguuuucauacagguaugguaaugguguuuggauaggaaggacuaaaaguaacagcuccagaagaggauuugagaugauuugggauccuaauggauggacagauaccgauaguaaauucuuagugaaacaggauguaguggcaaugacugauuggucaggguacagcggaagcuucguucaacauccugaacuaacaggauuggauuguaugaggccuugcuucuggguugaauugaucagaggacgaccuagagaaaauacaacaaucuggacuagugggagcagcauuucuuuuuguggcgugaauggugauacugcaaauuggucuuggccagacggugccgaguugccauucaccauugacaaguag

SEQ ID NO: 53634 - RNA, 1413 nt, Artificial Sequence
  neuraminidase__InfluenzaA__AFO64827
augaauccaaaucagaaaauaauaaccauuggaucaaucaguauggcaaucggaauaauuagucuaauauugcaaauaggaaauauuauuucaauauggguuagccacucaauccaaacuggaagucaaaaccauacuggaauaugcaaccaaagaaucauuacauaugaaaauagcaccuggguaaaucaaacauauguuaauauuaacaacacuaauguuauugcuggaaaggacaaaacuucagugacauuggccggcaauucaucucuuuguccuauccguggaugggcuauauacacaaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagguuugaaucaguugcuuggucagcaagcgcaugccaugauggcaugggcuggcuaacaaucggaauuucugguccagaugauggagcaguggcuguacuaaaauacaacggcauaauaacugaaaccauaaaaaguuggaagaagcgaauauuaagaacacaagagucugaaugugucugugugaacgguucauguuuuaccauaaugaccgauggcccgaguaauggggccgccucguacagaaucuucaaaaucgaaaaggggaaaguuacuaaaucaauagaguuggaugcacccaauucucauuacgaggaauguuccuguuacccagacaccggcacagugaugugugugugcagagauaauuggcacgguucaaaucgaccuugggugucuuuuaaucaaaaccuggauuaucaaauaggauacaucugcagugggguguucggugacaauccgcgucccaaagauggaaaaggcagcugugauccagugacuguugauggagcagacggaguaaagggguuuucauacagguaugguaaugguguuuggauaggaaggacuaaaaguaacagauucagaaagggauuugagaugauuugggauccuaauggauggacagauaccgacagugauuucuuagugaaacaggauguaguggcaaugacugauuggucaggguacagcggaaguuucguucaacauccugagcuaacaggauuggacuguaugagaccuugcuucuggguugaauuagucagagggcggccuagagaaaauacaacaaucuggacuagugggagcagcauuucuuuuuguggcgugaauagugauacugcaaacuggucuuggccagacggugccgaguugccauucaccaucgacaaguag

SEQ ID NO: 53635 - RNA, 1413 nt, Artificial Sequence
  neuraminidase__InfluenzaA__AFO64838
augaauccaaaucaaaaaauaauaaccauuggaucaaucaguauggcaaucggaauaauuagucuaauauugcaaauaggaaauauuauuucaauaugggcuagccacucaauccaaacuggaagucaaaaccacacuggaauaugcaaccaaagaaucauuacauaugaaaauagcaccugggugaaucaaacauauguuaauauuaacaacacuaauguuguugcuggaaaggacaaaaccucagugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcaugggcuggcuaacaaucggaauuucugguccagauaauggagcaguggcuguacuaaaauacaacggcauaauaacugaaaccauaaaaaguuggaagaagcgaauauuaagaacacaagagucugaaugugucugugugaacgguucauguuuuaccauaaugaccgauggcccgaguaauggggccgcaucguacagaaucuucaaaaucgagaaggggaggguuacuaaaucaauagaguuggaugcacccaauuaucauuacgaggaauguuccuguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggaugucguggcaaugacugauuggucaggguacagcggaaguuucguucaacauccugagcuaacaggauuggacuguaugagaccuugcuucuggguugaauuaguaagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 53636 - RNA, 1413 nt, Artificial Sequence
  neuraminidase__InfluenzaA__AFO64849
augaauccaaaucaaaaaauaauaaccauugggucaaucaguauggcaaucggaauaauuagucuaauauugcaaauaggaaauauuauuucaauaugggcuagccacucaauccaaaccggaagucaaaaccacacuggaauaugcaaccaaagaaucauuacauaugaaaauagcaccugggugaaucaaacauauguuaauauuaacaacacuaauguuguugcuggaaaggacaaaacuucagugacauuggccggcaauucaucucuuuguccuauccgugggugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagguuugaaucaguugcuuggucagcaagcgcaugccaugauggcaugggcuggcuaacaaucggaauuucugguccagauaauggagcaguggcuguacuaaaauacaacggcauaauaacugaaaccauaaaaaguuggaagaagcaaauauuaagaacacaagagucugaaugugucugugugaacgguucauguuuuaccauaaugacugauggcccgaguaauggggccgccucguacagaaucuucaaaauugagaaggggaagauuacuaaaucaauagaguuggaugcacccaauucucauuacgaggaauguuccuguuacccagacaccggcacagugaugugugugugcagggacaauuggcacgguucaaaucgaccuugggugucuuucaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucagugaaacaggaugucguggcaaugacugauuggucaggguacagcggaaguuucguucaacauccugagcuaacaggauuggacuguaugagaccuugcuucuggguugaauuagucagggggcgaccuagagaaaaugcaacaaucuggacuagugggagcagcauuucuuuuuguggcguaaauagugauacugcaaacuggucuuggccagacggugccgaguugccauucaccauugacaaguag

SEQ ID NO: 53637 - RNA, 1413 nt, Artificial Sequence
  neuraminidase__InfluenzaA__AFO64860
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuuuuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 53638 - RNA, 1413 nt, Artificial Sequence
  neuraminidase__InfluenzaA__AFO64871
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaguaugcaaccaaagaaucauuacauaugagaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggggauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagcgggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugagacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 53639 - RNA, 1413 nt, Artificial Sequence
  neuraminidase__InfluenzaA__AFO64882
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccgucuccauauaauucaaaguuugaaucaguugcuuggucagcaagcgcaugccaugauggcaugggcugguuaacaaucggaauuuccgguccagacaauggagcuguggcuguacuaaaauacaacggcauaauaacugaaaccauaaaaaguuggaaaaagcgaauauuaagaacacaagagucugaaugugucugugugaacgggucauguuuuaccauaaugaccgauggcccgaguaauggggccgccucguacaaaaucuucaagaucgaaaaggggaagguuacuaaaucaauagaguugaaugcacccaauucucauuaugaagaguguuccuguuacccagacacuggcacagugauguguguaugcagggacaacuggcacgguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggguuggacuguauaagaccuugcuucuggguugaguuagucagaggacggccuagagaaaauacaacaaucuggacuagugggagcagcauuucuuuuuguggcguaaauagugauacugcaaacuggucuuggccagacggugcugaguugccauucaccauugacaaguag

SEQ ID NO: 53640 - RNA, 1413 nt, Artificial Sequence
  neuraminidase__InfluenzaA__AFO64893
augaauccaaaucaaaaaauaauaaccauuggaucaaucaguguagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauaugucaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucauuuggaaugcagaaccuuuuuucugacccaaggugcucuauuaaaugacaaacauucaaaugggaccguuaaggacagaaguccuuauagggccuuaaugagcuguccucuaggugaagcuccgucuccauauaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcgaauauuaagaacacaagagucugaaugugucugugugaacgggucauguuuuaccauaaugaccgauggcccgagugauggggccgccucguacaaaaucuucaagaucgaaaaggggaagguuacuaaaucaauagaguugaaugcacccaauucucauuaugaggaauguuccuguuacccagacacuggcacagugauguguguaugcagggacaacuggcacgguucaaaucgaccuugggugucuuuuaaucaaaaccuggauuaucaaauaggguacaucugcagugggguguucggugacaacccgcgucccaaagauggagagggcagcuguaauccagugacuguugauggagcagacggaguaaagggguuuucauacaaauaugguaaugguguuuggauaggaaggacuaaaaguaacagauuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacggccuagagaaaauacaacaaucuggacuagugggagcagcauuucuuuuuguggcguaaauagugauacugcaaacuggucuuggccagacggugcugaguugccauucaccauugacaaguag

SEQ ID NO: 53641 - RNA, 1413 nt, Artificial Sequence
  neuraminidase__InfluenzaA__AFO64904
augaauccaaaucaaaaaauaauaaccauuggaucaaucaguguggcaaucggaauaauuagucuaauauugcaaauaggaaauauuauuucaaugugggcuagccacucaauccaaacuggaagucaaaacuacacuggaauaugcaaccaaagaaucauuacauaugaaaauaacaccuggguaaaucaaacauauguuaauauuaacaacacuaauguuguugcuggaaaggacaaaaucucaaugacauuggccggcaauucaucucuuugcccuauccguggaugggcuauauacacaaaagacaacagcauaagaauugguuccaaaggagauguuuuugucauaagagagccuuuuauuucauguucucacuuggaaugcagaaccuuuuuucugacccaaggugcucuauuaaaugacaagcauucaaaugggaccguuaaggacagaagcccuuauagggccuuaaugagcuguccucugggugaagcuccgucuccauacaauucaagauuugaaucaguugcuuggucagcaagcgcaugccaugauggcuugggcuggcuaacaaucggaauuucugguccagauaauggagcaguggcuguacuaaaauacaacggcauaauaacugaaaccauaaaaaguuggaagaagcaaaucuuaagaacucaagagucugaaugugucugugugaacggcucauguuuuacaauaaugaccgauggcccgaguaauagggccgcaucguacagaaucuucaaaaucgagaaggggagaguuacuaaaucaauagaguuggaugcacccaauuaucauuacgaagaauguuccuguuacccagacaccggcacaguaaugugugugugcagggacaauuggcacgguucaaaucgaccuugggugucuuuuaaucaaaaccuugauuaucaaauaggauacaucugcagugggguguucggugacaauccgcgucccaaagauggagaaggcagcuguaauccagugacuguugacggagcagacggaguaaagggguuuucauacaaauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacgaucuggacuagugggagcagcauuucuuuuuguggcguaaauagcgagacugcaaacuggucuuggccagacggugcugaguugccauucacuauugacaaguag

SEQ ID NO: 53642 - RNA, 1413 nt, Artificial Sequence
  neuraminidase__InfluenzaA__AFO65019
augaauccaaaucaaaaaauaauaaccauuggaucaaucaguauagcaaucggaauaauuagucuaauguugcaaauaggaaauauuauuucaauaugggcuagucauucaauccaaacuggaagucaaaaccacacuggaauaugcaaccaaagaaucaucacauaugaaaacagcaccugggugaaucauacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccgucuccauauaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcgaauauuaagaacacaagagucugaaugugucugugugaacgggucauguuuuaccauaaugaccgauggcccgaguaauggggccgccucguacaaaaucuucaagaucgaaaaggggaagguuacuaaaucaauagaguugaacgcacccaauucucauuaugaggaauguuccuguuacccagacacuggcacagugauguguguaugccgggacaacuggcacgguucaaaucggccuugggugucuuuuaaucaaaaccuggauuaucaaauaggauacaucugcagugggguguucggugacaauccgcgucccaaagauggagagggcagcuguaauccagugacugcugauggagcagacggaguaaagggguuuucauacaaauaugguaaugguguuuggauaggaaggacuaaaaguaacagacuuagaaagggguucgagaugauuugggauccuaauggauggacagauaccgacagugauuucucagugaaacaagauguuguggcaauaacugauuggucaggguacagcggaaguuucguucaacauccugaguuaacaggauuggacuguauaaggccuugcuucuggguugaguuagucagaggacggccuagagaaaauacaacaaucuggacuagugggagcagcauuucuuuuuguggcguaaauagugauacugcaaacuggucuuggccagacggugcugaguugccauucaccauugacaaguag

SEQ ID NO: 53643 - RNA, 1413 nt, Artificial Sequence
  neuraminidase__InfluenzaA__AFO65030
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuguugccggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 53644 - RNA, 1413 nt, Artificial Sequence
  neuraminidase__InfluenzaA__AFO65041
augaauccaaaucaaaaaauaauaaccauugggucaaucaguauagcaaucggaauaauuagucuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 53645 - RNA, 1413 nt, Artificial Sequence
  neuraminidase__InfluenzaA__AFO65052
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuauugcuggaaaggacaaaacuucaaugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugcaaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 53646 - RNA, 1413 nt, Artificial Sequence
  neuraminidase__InfluenzaA__AFO66139
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguccaacauccugaguuaacaggauuggacuguauaagaccuugcuucuggguugaguuggucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 53647 - RNA, 1413 nt, Artificial Sequence
  neuraminidase__InfluenzaA__AFO66150
augaauccaaaucaaaaaauaauaaccauuggaucaaucaguguggcaaucggaauaauuagucuaauauugcaaauaggaaauauuauuucaauaugggcuagccacucaauccaaacuggaagucaaaacuacacuggaauaugcaaccaaagaaucauuacauaugaaaauaggaccuggguaaaucaaacauauguuaauauuaacaacacuaauguuguugcuggaaaggacaaaaccucgaugacauuggccggcaauucaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucugggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuauccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaagaguaacagaauaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaacacaacaaucuggacuagugggagcagcauuucuuuuuguggcgugaauagcgagacugcaaacuggucuuggccagacggugcugaguugccauucaccauugacaaguag

SEQ ID NO: 53648 - RNA, 1413 nt, Artificial Sequence
  neuraminidase__InfluenzaA__AFO66161
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucggcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaggagucugaaugugucuguguaaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauuuguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagacaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguaa

SEQ ID NO: 53649 - RNA, 1413 nt, Artificial Sequence
  neuraminidase__InfluenzaA__AFO66172
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccgugggugucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugguaaugguguuuggauaggaaggacuaaaaguaacagacuuagaaagggguuugaaaugauuugggauccuaauggguggacagauaccgacagugauuucucagugaaacaagauguuguagcaauaacugauuggucaggguacagcggaaguuucguucaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53650 - RNA, 1413 nt, Artificial Sequence; identical to SEQ ID NO: 45434
  neuraminidase__InfluenzaA__AFO66183

SEQ ID NO: 53651 - RNA, 1413 nt, Artificial Sequence
  neuraminidase__InfluenzaA__AFO66194
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauauuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 53652 - RNA, 1410 nt, Artificial Sequence
  neuraminidase__InfluenzaA__AFO66205
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggagcugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 53653 - RNA, 1413 nt, Artificial Sequence
  neuraminidase__InfluenzaA__AFO66216
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacaccuauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcuguaauccagugacuguugauggagcagacggaguaaaggguuuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53654 - RNA, 1413 nt, Artificial Sequence; identical to SEQ ID NO: 44890
  neuraminidase__InfluenzaA__AFO66227

SEQ ID NO: 53655 - RNA, 1413 nt, Artificial Sequence
  neuraminidase__InfluenzaA__AFO66238
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcaaauauuaagaacacaagagucugaaugugucuguaugaacgggucauguuucaccauaaugaccgauggcccgaguaauggggccgccucguacaaaauuuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53656 - RNA, 1413 nt, Artificial Sequence
  neuraminidase__InfluenzaA__AFO66249
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauggggccgccucguacaaaauuuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53657 - RNA, 1413 nt, Artificial Sequence
  neuraminidase__InfluenzaA__AFP33330
augaauccaaaucaaaaaauaauaaccauuggaucaaucaguguggcaaucggaauaauuagucuaauauugcaaauaggaaauauuauuucaauaugggcuagccacucaauccaagcuggaagucaaaacuacacuggaauaugcaaccaaaaaaucauuacauaugaaaauagaaccuggguaaaucaaacauauguuaauauuaacaacacuaauguuguugcuggaaaggacaaaaccucgaugacauuggccggcaauucaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucugggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuauccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 53658 - RNA, 1413 nt, Artificial Sequence
  neuraminidase__InfluenzaA__AFP33331
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcacuugggugaaucacacauauguuaauauuaacaacacuaauguuauugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaauuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacugcauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 53659 - RNA, 1410 nt, Artificial Sequence
  neuraminidase__InfluenzaA__AFQ32576
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaaacaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccuuaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauaguauuguuuccaguuauguguguucaggacuuguuggagacacacccagaaaaaacgacagcuccagcaguagccauuguuuggauccuaacaaugaggaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuauggaccucaaacaguauuguuguguuuuguggcaccucagguacauauggaacaggcucauggccugauggggcggaucucaaucucaugccuauauaa

SEQ ID NO: 53660 - RNA, 1410 nt, Artificial Sequence
  neuraminidase__InfluenzaA__AFQ37282
augaauccaaaccaaaagauaauaaccauugguucggucuguaugacaauuggaauggcuaaccuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcucuuguuauccugauucuagugaaaucacaugugugugcagggauaacuggcauggcucgaaucgaccgugggugucuuucaaccagaaucuggaauaucagauaggauacauaugcagugggauuuucggggacaauccacgcccuaaugauaagacaggcaguugugguccaguaucgucuaauggagcaaauggaguaaaaggguuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuggcgggagcagcauauccuuuugugguguaaacagugacacuguggguuggucuuggccagacggugcugaguugccauuuaccauugacaaguaa

SEQ ID NO: 53661 - RNA, 1410 nt, Artificial Sequence
  neuraminidase__InfluenzaA__AFQ55691
augaauccaaaucagaagauaauaacaaucgggguagugaauaccacucugucaacaauagcccuucucauuggagugggaaacuuagucuucaacacagucauacaugagaaaauuggagaucaccaaacagugacccauccaacaacaacgaccccugcgauaccgaacugcagcgacacuauaauaacauacaauaacacuauaauaaacaacauaacaacaacgauaauaacugaagcagaaaggccuuucaagucuccacuaccgcugugccccuucagaggauucuucccuuuucacaaggacaaugcaauacgacugggugagaacaaagacgucauagucacaagggagcccuacgucagcugugauaaugacaacugcugguccuuugcucucgcacaaggggcauugcuagggacuaaacauagcaauggaaccauuaaagacagaacaccauaucggucccuaauucguuucccaauaggaacagcuccaguacuagggaauuauaaggaaauaugcauugcuuggucgagcaguaguugcuuugacgggaaagaguggaugcaugugugcaugacagggaaugauaaugaugcaagugcccagauaauauaugcagggaaaaugacagacuccauuaaaucauggagaaaggacauacuaaggacccaggagucugaaugccagugcauugacgggacuuguguuguugcugucacagacggcccugcugcuaguagugcagaccacaggauuuacuggauacgggaggggaaaauaauaaaguaugaagauguucccaagacaaagauacaacacuuagaagaauguuccugcuauguggacguugauguuuacuguauauguagggacaauuggaaggguuccaauaggccuuggaugagaaucaacaacgagacuauacuggaaacaggguaugugugcaguaaauuucacucagacacucccaggccagccgacccuucuacagugucaugugacuccccaagcaaugucaauggaggacccggaguaaagggguuugguuucaaagccggcaaugauguaugguuagggagaacagugucaacuagugguagaucaggcuuugaaauuaucaaaguuacagagggguggaucaacucucccaaucaugccaaaucaauuacacaaacacugauguccaacaaugacuggucgggcuacucaggcagcuucauuaucaaaaccaaggacuguuuucagcccugcuuuuauguugagcucauacgagggaggcccaacaagaaugaugaugucucuuggacaagcaauaguauaguuacuuucuguggguuagacaaugaaccuggaucgggaaauuggccggaugguucuaacauuggguuuaugcccaaguaa

SEQ ID NO: 53662 - RNA, 1410 nt, Artificial Sequence
  neuraminidase__InfluenzaA__AFR68156
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 53663 - RNA, 1410 nt, Artificial Sequence
  neuraminidase__InfluenzaA__AFR68166
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 53664 - RNA, 1410 nt, Artificial Sequence
  neuraminidase__InfluenzaA__AFR68176
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguugcuucaugguccaaagacauccucaggacccaggagucagaaugcguuuguaucaauggaacuugugcgguaguaaugacugaugggagugcuucaggaaaagcugauacuaaaauacuauucauuaaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccgaaguccaaauugcagauaaauaggcaagucauaguugacagagguaauagguccgguuauucugguauuuucucuguugaaggcaagaacugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53665 - RNA, 1410 nt, Artificial Sequence; identical to SEQ ID NO: 47242
  neuraminidase__InfluenzaA__AFR84677

SEQ ID NO: 53666 - RNA, 1410 nt, Artificial Sequence; identical to SEQ ID NO: 51819
  neuraminidase__InfluenzaA__AFR84687

SEQ ID NO: 53667 - RNA, 1410 nt, Artificial Sequence; identical to SEQ ID NO: 47241
  neuraminidase__InfluenzaA__AFR84696

SEQ ID NO: 53668 - RNA, 1410 nt, Artificial Sequence; identical to SEQ ID NO: 47562
  neuraminidase__InfluenzaA__AFR84706

SEQ ID NO: 53669 - RNA, 1410 nt, Artificial Sequence; identical to SEQ ID NO: 47241
  neuraminidase__InfluenzaA__AFR84716

SEQ ID NO: 53670 - RNA, 1410 nt, Artificial Sequence; identical to SEQ ID NO: 47241
  neuraminidase__InfluenzaA__AFR84726

SEQ ID NO: 53671 - RNA, 1410 nt, Artificial Sequence; identical to SEQ ID NO: 47241
  neuraminidase__InfluenzaA__AFR84736

SEQ ID NO: 53672 - RNA, 1410 nt, Artificial Sequence; identical to SEQ ID NO: 47241
  neuraminidase__InfluenzaA__AFR84746

SEQ ID NO: 53673 - RNA, 1410 nt, Artificial Sequence; identical to SEQ ID NO: 47241
  neuraminidase__InfluenzaA__AFR84756

SEQ ID NO: 53674 - RNA, 1410 nt, Artificial Sequence; identical to SEQ ID NO: 47241
  neuraminidase__InfluenzaA__AFR84766

SEQ ID NO: 53675 - RNA, 1410 nt, Artificial Sequence; identical to SEQ ID NO: 47241
  neuraminidase__InfluenzaA__AFR84776

SEQ ID NO: 53676 - RNA, 1410 nt, Artificial Sequence; identical to SEQ ID NO: 47241
  neuraminidase__InfluenzaA__AFR84786

SEQ ID NO: 53677 - RNA, 1410 nt, Artificial Sequence; identical to SEQ ID NO: 47241
  neuraminidase__InfluenzaA__AFR84796

SEQ ID NO: 53678 - RNA, 1410 nt, Artificial Sequence; identical to SEQ ID NO: 47242
  neuraminidase__InfluenzaA__AFR84806

SEQ ID NO: 53679 - RNA, 1410 nt, Artificial Sequence; identical to SEQ ID NO: 47241
  neuraminidase__InfluenzaA__AFR84816

SEQ ID NO: 53680 - RNA, 1410 nt, Artificial Sequence; identical to SEQ ID NO: 47242
  neuraminidase__InfluenzaA__AFR84826

SEQ ID NO: 53681 - RNA, 1410 nt, Artificial Sequence
  neuraminidase__InfluenzaA__AFR84836
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53682 - RNA, 1410 nt, Artificial Sequence; identical to SEQ ID NO: 51864
  neuraminidase__InfluenzaA__AFR84846

SEQ ID NO: 53683 - RNA, 1410 nt, Artificial Sequence; identical to SEQ ID NO: 47242
  neuraminidase__InfluenzaA__AFR84856

SEQ ID NO: 53684 - RNA, 1410 nt, Artificial Sequence
  neuraminidase__InfluenzaA__AFR84866
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauuucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53685 - RNA, 1410 nt, Artificial Sequence; identical to SEQ ID NO: 48139
  neuraminidase__InfluenzaA__AFR84876

SEQ ID NO: 53686 - RNA, 1410 nt, Artificial Sequence; identical to SEQ ID NO: 51864
  neuraminidase__InfluenzaA__AFR84895

SEQ ID NO: 53687 - RNA, 1410 nt, Artificial Sequence; identical to SEQ ID NO: 51864
  neuraminidase__InfluenzaA__AFR84905

SEQ ID NO: 53688 - RNA, 1410 nt, Artificial Sequence; identical to SEQ ID NO: 51864
  neuraminidase__InfluenzaA__AFR84915

SEQ ID NO: 53689 - RNA, 1410 nt, Artificial Sequence; identical to SEQ ID NO: 51864
  neuraminidase__InfluenzaA__AFR84925

SEQ ID NO: 53690 - RNA, 1353 nt, Artificial Sequence
  neuraminidase__InfluenzaA__AFU83119
augaauccaaaucagaagauaauaacaaucggcucugucucucuaaccauugcaacaguguguuuccucaugcagauugccauccuagcaacgacuguaacgcugcacuucaagcaaaaugaaugcaguauccccucgagcaaucaaguggugccaugugagccaaucauaguagaaagaaacguaacagaauacagggauuggucgaaaccgcagugccagauuacaggguuugcuccuuuuuccaaggacaacucaauccggcuuucugcugguggggacaucuggguaacaagggaaccuuaugugucgugcagccccgauaaauguuaucaauucgcacuugggcagggaacaacgcuggacaacaaacacucaaauggcacaauacaugauaggauuccucaccggacccuuuugaugaacgaguuggguguuccguuucauuuggggacuaaacaggucugcauagcgugguccagcucaagcugccacgauggaagagcaugguugcacguuuguguuacuggggacgauaggaaugcaacugcuaguuucauuuaugauggggugcuuguugacaguauugguucauggucucaaaacauucucagaacucaggagucagaaugcgucuguauuaauggaacuuguacaguaguaaugacugauggaagugcaucaggaagggcugauaccagaauauuguucauuaaagaggggaaaauuguccaugucagcccauuaucaggaagugcucaacauauagaggaauguuccuguuauccccguuauccagacguuagaugugucuguagagacaauuggaaagguucaaauaggcccauuauagauauaaguauggcagauuauggcauugauucuaguuaugugugcucggggcuuguuggagacacaccaagaaacgaugauaguucuagcaacagcaacugcaaggauccuaauaacgagagaggaaauccaggagugaaagggugggcuuuugacuauggaaaugauguuuggaugggaagaacaaucagcaaggauucacgcucagguuaugagacuuucagagucauuggcgguuggaccauagcuaauuccaaaucucagguaaacaggcaagucauaguugacaauaauaacuggucugguuauucuggcaucuucucuguugaaggcaaaagcugcaucaauagguguuuuuauguugaguugauaagaggaaggccacaagagacuagagugugguggaccucaaacaguauuguugcauuuuguggcacuucagguacuuauggaacaggcucauggccugauggagcgaacaucaauuucaugccuauauaa

SEQ ID NO: 53691 - RNA, 1410 nt, Artificial Sequence
  neuraminidase__InfluenzaA__AFV53208
augaauccaaaucaaaagauaauaacaauuggcucugucucucucaccauugcaacaguaugcuuccucauucagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagggaaccuuaugugucaugcgauccuggcaaguguuaucaauuugcacucgggcaagggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugauaaaaaugcaacugcuagcuucauuuaugacgggaggcuuauggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucauagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauaggcaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 53692 - RNA, 1410 nt, Artificial Sequence
  neuraminidase__InfluenzaA__AFV53219
augaauccaaaucaaaagacaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgacccuggcaaguguuaucaauuugcacucgggcaggggaccacacuagacaacaaacauucaaauggcacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacguaagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugaaagagggaauccaggagugaaaggcugggccuuugacaauggagaugauguauggaugggaagaacaaucaacaaagaaucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 53693 - RNA, 1410 nt, Artificial Sequence
  neuraminidase__InfluenzaA__AFV53230
augaauccaaaucaaaagauaauaacaauuggcucugucucucucaccauugcaacaguaugcuuccucaugcagauugccauccugguaacuacuguaacauugcauuucaagcaacaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuuguacaguaguaaugacugauggaagugcuucaggaagagccgauacuaaaauacuauucauugaagaggggaaaauuguccauauuagcccauugucaggaagugcucagcauguagaggaguguuccuguuauccucgauacccugacgucagauguaucugcagagacaacuggaaaggcuccaauaggcccgucguagacauaaguauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauaggcaagucauaguugacagcgauaauaggucagguuauucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuaugggacaggcucauggccugauggggcgaacaucaaucucaugccuauauaa

SEQ ID NO: 53694 - RNA, 1410 nt, Artificial Sequence
  neuraminidase__InfluenzaA__AFV53241
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagaucugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaaugcaacugcuagcuucauuuaugacgggaggcuuauggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucauagacauaaauauggaagauuauagcauugauuccaguuaugugugcucagggcuuguuggcgacacacccagaaacgacgacagaucuagcaauaguaauugcaggaauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagaugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 53695 - RNA, 1410 nt, Artificial Sequence
  neuraminidase__InfluenzaA__AFV53252
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagauaugccccaaaguagugggauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcagggaaccacacuagacaacaaacauucaaaugacacaauacaugauagaaucccucaucgaacccuauuaaugaaugaguuggguguuccauuucaucuaggaaccaggcaaguguguauagcaugguccagcucaaguugucacgauggaaaagcauggcugcauguuuguaucacuggggaugauaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccgggcguaagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucucagaucaauagacaagucauaguugacagcgauaaucggucagguuacuccgguauuuucucuguugagggcaaaagcugcaucaauaggugcuuuuauguggaguugauaaggggaaggaaacaggaaacuagaguaugguggaccucaaacaguauuguuguguuuuguggcacuucagguaccuauggaacaggcucauggccugauggggcgaacaucaauuucaugccuauauaa

SEQ ID NO: 53696 - RNA, 1413 nt, Artificial Sequence
  neuraminidase__InfluenzaA__AFV53263
augaacccaaaucagaaaauaauaaccauuggaucaaucuguauggcaaucggaacaaucagucuaauacugcaaauagggaauauuaucucaauauggauuagccacucaauucaaacuggaagucaaaaccauacuggaauaugcaaccaaagaaucauuaccuaugaaaauaauaccuggguaaaucaaaccuauguuaauauuagcaacacuaacguuguugcuggaaaggacacaacuucaaugauauuagccggcaauucaucucuuuguccuauccgugggugggcuauauacagcaaggacaacagcauaagaauugguuccaaaggagauguuuuugucauaagagaaccuuuuauaucaugcucucacuuggaaugcagaaccuuuuuucugacccaaggcgcucuguuaaaugacaagcauucaaaugggaccguuaaggacagaagcccuuauagggccuuaaugagcuguccuauuggugaagcuccgucuccguacaauucaagauuugaaucgguugcuuggucagcgagugcaugucaugauggcaugggcuggcuaacaaucggaauuucugguccagaugauggagcaguggcuguauuaaaauacaacggcauaauaacugaaaucauaaaaaguuggaggaaacaaauauuaagaacacaagagucugaaugugucuguguaaacgguucauguuuuaccauaaugaccgaugguccgaguaauaggccggccucguacagaaucuucaaaaucgagaaggggaagauuacuaaaucaauagaguuggaugcaccuaauucucauuacgaggaauguuccuguuacccagacaccggcaaagugaugugugugugcagagacaauuggcaugguucgaaucgaccgugggugucuuuuaaccaaaaccuggauuaucaaauaggauacaucugcagugggguuuucggugacaauccgcgucccaaagauggaaagggcagcugugauccaguaaauguugauggagcagacggaguaaagggguuuucauacagguaugguaaugguguuuggauaggaaggacuaaaaguaacaguuccagaaagggguuugagaugauuugggauccuaauggguggacaaauaccgaugguaauuucucagugaaacaggaugugguggcaaugacugauuggucaggguauaguggaaguuucguucaacauccugagcuaacaggauuggacuguauaagaccuugcuucuggguugaauuaaucagaggacgacccagagaagaaacaacuaucuggacuagugggagcagcauuucuuuuuguggcgugaauagugauacuguaaauuggucuuggccagacggugccgaguugccauucaccauugacaaguag

SEQ ID NO: 53697 - RNA, 1410 nt, Artificial Sequence
  neuraminidase__InfluenzaA__AFV53274
augaauccaaaucaaaagauaauaacaauuggcucugucucucucaucauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagaucugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaaugcaacugcuagcuucauuuaugacgggaggcuuguggacaguauugguucauggucucaaaauauccucaggacccaggaaucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucauagacauaaauauggaagauuauagcauugauuccaguuaugugugcucagggcuuguuggcgacacacccagaaacgacgacagaucuagcaauaguaauugcaggaauccuaacaaugagagagggaaucccggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 53698 - RNA, 1410 nt, Artificial Sequence
  neuraminidase__InfluenzaA__AFV53285
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgacauccugacgucagauguaucugcagagacaacuggaaaggaucuaauaggcccguuauaaacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 53699 - RNA, 1410 nt, Artificial Sequence
  neuraminidase__InfluenzaA__AFV53296
augaauccaaaucaaaagauaauaauaauuggcucugucucucucaccauugcaacaguaugcuuccucaugcagauugccauccugguaacuacuguaacauugcauuuuaagcaacaugagugcgacucccccgcgagcaaccaaguaaugccaugugaaccaauaauaauagaaaggaacauaacagagauaguguauuugaauaacaccaccauagagaaagagaucugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuagcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagauaacuggaaaggcucuaauaggcccgucauagacauaaauauggaagauuauagcauugauuccaguuaugugugcucagggcuuguuggcgacacacccagaaacgacgauagaucuagcaauagcaauugcagggauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 53700 - RNA, 1410 nt, Artificial Sequence
  neuraminidase__InfluenzaA__AFV53307
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauguagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 53701 - RNA, 1410 nt, Artificial Sequence
  neuraminidase__InfluenzaA__AFV53317
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaagcccucaucgaacccuauuaaugaaugaguuggguguuccauuucauuuaggaaccaaacaagugugugcagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuggcccauugucaggaagugcucagcauauagaggaguguucuuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguauuuuguggcacuucagguacuuauggaacaggcucauggccugauggggcgaacaucaauuucaugccuauauaa

SEQ ID NO: 53702 - RNA, 1410 nt, Artificial Sequence
  neuraminidase__InfluenzaA__AFV53328
augaauccaaaucaaaagauaauaacaauuggcucugucucucucaccaucgcaacaguaugcuuccucaugcauauugccauccuggcaacuacugugacauugcacuucaagcaacaugagugcgacucccccgcgagcaaccaagcaaugccaugcgaaccaauaauaauagaaaggaacauaacagagauaguguauuugaauaacaccaccauagagaaagagauuugccccgaaguaguagaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuuguaucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 53703 - RNA, 1410 nt, Artificial Sequence
  neuraminidase__InfluenzaA__AFV53339
augaauccaaaucaaaagauaauaacaauuggcucugccucucucaccauugcaacaguaugcuuccucaugcagauugccauccugguaacuacuguaacauugcauuucaagcaacaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuuguacaguaguaaugacugauggaagugcuucaggaagagccgauacuagaauacuauucauugaagaggggaaaauuguccauaugagcccauugucaggaagugcucagcauguagaggaguguuccuguuauccucgauauccugacgucagauguaucugcagagacaacuggaaaggcucuaauaggcccgucguagacauaaauauggaagauuauagcauugauuccaguuaugugugcucagggcuuguuggagacacaccuagaaacgacgacagaucuagcaauagcaauugcagaaauccuaacaaugagaaagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauaggcaagucauaguugacagcgauaauaggucagguuauucugguauuuucucuguugagggcaaaagcugcaucaauaggugcuuuuauguggaguugauaaggggaaggaaacaggagacuagaguaugguggaccucaaacaguauuguuguguucuguggcacuucagguaccuaugggacaggcucauggccugauggggcgaacaucaaucucaugccuauauaa

SEQ ID NO: 53704 - RNA, 1410 nt, Artificial Sequence
  neuraminidase__InfluenzaA__AFX96367
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaaugggaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaacccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53705 - RNA, 1410 nt, Artificial Sequence
  neuraminidase__InfluenzaA__AFX96386
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53706 - RNA, 1410 nt, Artificial Sequence
  neuraminidase__InfluenzaA__AFX96401
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaaaaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53707 - RNA, 1410 nt, Artificial Sequence; identical to SEQ ID NO: 53706
  neuraminidase__InfluenzaA__AFX96411

SEQ ID NO: 53708 - RNA, 1410 nt, Artificial Sequence; identical to SEQ ID NO: 53706
  neuraminidase__InfluenzaA__AFX96421

SEQ ID NO: 53709 - RNA, 1410 nt, Artificial Sequence; identical to SEQ ID NO: 53706
  neuraminidase__InfluenzaA__AFX96431

SEQ ID NO: 53710 - RNA, 1410 nt, Artificial Sequence; identical to SEQ ID NO: 53706
  neuraminidase__InfluenzaA__AFX96441

SEQ ID NO: 53711 - RNA, 1410 nt, Artificial Sequence; identical to SEQ ID NO: 53706
  neuraminidase__InfluenzaA__AFX96451

SEQ ID NO: 53712 - RNA, 1410 nt, Artificial Sequence; identical to SEQ ID NO: 53706
  neuraminidase__InfluenzaA__AFX96461

SEQ ID NO: 53713 - RNA, 1410 nt, Artificial Sequence; identical to SEQ ID NO: 47242
  neuraminidase__InfluenzaA__AFX96471

SEQ ID NO: 53714 - RNA, 1410 nt, Artificial Sequence; identical to SEQ ID NO: 47242
  neuraminidase__InfluenzaA__AFX96481

SEQ ID NO: 53715 - RNA, 1410 nt, Artificial Sequence; identical to SEQ ID NO: 47242
  neuraminidase__InfluenzaA__AFX96491

SEQ ID NO: 53716 - RNA, 1410 nt, Artificial Sequence; identical to SEQ ID NO: 47242
  neuraminidase__InfluenzaA__AFX96501

SEQ ID NO: 53717 - RNA, 1410 nt, Artificial Sequence; identical to SEQ ID NO: 48503
  neuraminidase__InfluenzaA__AFX96511

SEQ ID NO: 53718 - RNA, 1410 nt, Artificial Sequence
  neuraminidase__InfluenzaA__AFX96521
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuaggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53719 - RNA, 1410 nt, Artificial Sequence; identical to SEQ ID NO: 47242
  neuraminidase__InfluenzaA__AFX96531

SEQ ID NO: 53720 - RNA, 1410 nt, Artificial Sequence; identical to SEQ ID NO: 53705
  neuraminidase__InfluenzaA__AFX96541

SEQ ID NO: 53721 - RNA, 1410 nt, Artificial Sequence
  neuraminidase__InfluenzaA__AFX96551
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcucuuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53722 - RNA, 1410 nt, Artificial Sequence
  neuraminidase__InfluenzaA__AFX96561
augaauccaaaccaaaagauaauaaccauugguuuggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53723 - RNA, 1410 nt, Artificial Sequence; identical to SEQ ID NO: 48596
  neuraminidase__InfluenzaA__AFX96571

SEQ ID NO: 53724 - RNA, 1410 nt, Artificial Sequence; identical to SEQ ID NO: 48596
  neuraminidase__InfluenzaA__AFX96581

SEQ ID NO: 53725 - RNA, 1410 nt, Artificial Sequence; identical to SEQ ID NO: 47242
  neuraminidase__InfluenzaA__AFX96591

SEQ ID NO: 53726 - RNA, 1410 nt, Artificial Sequence; identical to SEQ ID NO: 47242
  neuraminidase__InfluenzaA__AFX96601

SEQ ID NO: 53727 - RNA, 1410 nt, Artificial Sequence
  neuraminidase__InfluenzaA__AFX96611
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauuaagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53728 - RNA, 1410 nt, Artificial Sequence; identical to SEQ ID NO: 51490
  neuraminidase__InfluenzaA__AFX96621

SEQ ID NO: 53729 - RNA, 1410 nt, Artificial Sequence; identical to SEQ ID NO: 48596
  neuraminidase__InfluenzaA__AFX96631

SEQ ID NO: 53730 - RNA, 1410 nt, Artificial Sequence
  neuraminidase__InfluenzaA__AFX96641
augaauccaaaccaaaagauaauaaccauugguucggucuguaugacaauuggaauggcuaacuuaauauuacaaauuggaaauauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaaaauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53731 - RNA, 1410 nt, Artificial Sequence; identical to SEQ ID NO: 48311
  neuraminidase__InfluenzaA__AFX96651

SEQ ID NO: 53732 - RNA, 1410 nt, Artificial Sequence
  neuraminidase__InfluenzaA__AFX96661
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaaaggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53733 - RNA, 1410 nt, Artificial Sequence
  neuraminidase__InfluenzaA__AFX96671
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacaggacuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53734 - RNA, 1410 nt, Artificial Sequence; identical to SEQ ID NO: 47242
  neuraminidase__InfluenzaA__AFX96681

SEQ ID NO: 53735 - RNA, 1410 nt, Artificial Sequence; identical to SEQ ID NO: 48596
  neuraminidase__InfluenzaA__AFX96691

SEQ ID NO: 53736 - RNA, 1410 nt, Artificial Sequence
  neuraminidase__InfluenzaA__AFX96701
augaauccaaaccaaaagauaauaaccauugguucggucuguaugacaauuggaauggcuaacuuaauauuacaaauuggaaacauaauaucgauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguuuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccagacggugcugaguugccauuuaccauugacaaguaa

SEQ ID NO: 53737 - RNA, 1410 nt, Artificial Sequence
  neuraminidase__InfluenzaA__AFX96711
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagauaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53738 - RNA, 1410 nt, Artificial Sequence
  neuraminidase__InfluenzaA__AFX96721
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacagucuggacuagcgggagcagcauauccuuuugugguguaaacagugacacuguggguuggucuuggccagacggugcugaguugccauuuaccauugacaaguaa

SEQ ID NO: 53739 - RNA, 1410 nt, Artificial Sequence; identical to SEQ ID NO: 53738
  neuraminidase__InfluenzaA__AFX96731

SEQ ID NO: 53740 - RNA, 1410 nt, Artificial Sequence
  neuraminidase__InfluenzaA__AFX96741
augaauccaaaccaaaagauaauaaccauugguucggucuguaugacaauuggaauggcuaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauaugucaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53741 - RNA, 1410 nt, Artificial Sequence
  neuraminidase__InfluenzaA__AFX96751
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacaccauuaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53742 - RNA, 1410 nt, Artificial Sequence
  neuraminidase__InfluenzaA__AFX96761
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgaccuaaagagaacacaaucuggacuagcgggagcagcauauccuuuugugguguaaacagugacacuguggguuggucuuggccagacggugcugaguugccauuuaccauugacaaguaa

SEQ ID NO: 53743 - RNA, 1410 nt, Artificial Sequence
  neuraminidase__InfluenzaA__AFX96771
augaauccaaaccaaaagauaauaaccauugguucggucuguaugacaauuggaauggcuaacuugauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggaguccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53744 - RNA, 1410 nt, Artificial Sequence
  neuraminidase__InfluenzaA__AFX96791
augaauccaaaccaaaagauaauaaccauugguucggucuguaugacaauuggaauggcuaacuuaauauuacaaguuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguauaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53745 - RNA, 1410 nt, Artificial Sequence; identical to SEQ ID NO: 53744
  neuraminidase__InfluenzaA__AFX96801

SEQ ID NO: 53746 - RNA, 1410 nt, Artificial Sequence
  neuraminidase__InfluenzaA__AFX96811
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugagauuagcgggcaauuccucucucugcccuguuaguggaugggcuauauacaguaaagacaacaguauaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguauaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53747 - RNA, 1410 nt, Artificial Sequence; identical to SEQ ID NO: 47242
  neuraminidase__InfluenzaA__AFX96821

SEQ ID NO: 53748 - RNA, 1410 nt, Artificial Sequence; identical to SEQ ID NO: 53744
  neuraminidase__InfluenzaA__AFX96831

SEQ ID NO: 53749 - RNA, 1410 nt, Artificial Sequence
  neuraminidase__InfluenzaA__AFX96841
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugagauuagcgggcaauuccucucucugcccuguuaguggaugggcuauauacaguaaagacaacaguauaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaaccgacacuaucaagaguuggagaaacaauauauugagaacacaagaaucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuacccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauucucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53750 - RNA, 1410 nt, Artificial Sequence; identical to SEQ ID NO: 47298
  neuraminidase__InfluenzaA__AFX96859

SEQ ID NO: 53751 - RNA, 1410 nt, Artificial Sequence; identical to SEQ ID NO: 47242
  neuraminidase__InfluenzaA__AFX96907

SEQ ID NO: 53752 - RNA, 1410 nt, Artificial Sequence
  neuraminidase__InfluenzaA__AFX96917
augaauccaaaccaaaagauaauaaccauugguucggucuguaugacaauuggaauggcuaacuuaauauuacaaauuggaaacauaaucucaauauggauuagccacuccauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53753 - RNA, 1410 nt, Artificial Sequence; identical to SEQ ID NO: 47242
  neuraminidase__InfluenzaA__AFX96927

SEQ ID NO: 53754 - RNA, 1410 nt, Artificial Sequence
  neuraminidase__InfluenzaA__AFX96937
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcagcaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguuggaauaaaugaguggucaggauauagcgggaguuuuguucagcauccagaacuaacagggcuggauuguauaagaccuugcuucuggguugaacuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 53755 - RNA, 1410 nt, Artificial Sequence; identical to SEQ ID NO: 47241
  neuraminidase__InfluenzaA__AFY23991

SEQ ID NO: 53756 - RNA, 1410 nt, Artificial Sequence; identical to SEQ ID NO: 47242
  neuraminidase__InfluenzaA__AFY24001

SEQ ID NO: 53757 - RNA, 1410 nt, Artificial Sequence; identical to SEQ ID NO: 48505
  neuraminidase__InfluenzaA__AFY24022

SEQ ID NO: 53758 - RNA, 1410 nt, Artificial Sequence
  neuraminidase__InfluenzaA__AFY24043
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagagcuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucaguugaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucguucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53759 - RNA, 1410 nt, Artificial Sequence
  neuraminidase__InfluenzaA__AFY24153
augaauccaaaucaaaagauaauaacaauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaacggauuauagcauuguuuccaguuaugugugcucaggacuuguuggagacacacccagaaaaaacgacagcuccagcaguagccauugcuuggauccuaacaaugaagaagguggccauggagugaaaggcugggccuuugaugauggaaaugacguauggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53760 - RNA, 1410 nt, Artificial Sequence
  neuraminidase__InfluenzaA__AFY24208
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacauaauaggaccccuuaucggacccuauugaugaaugaguuggguguuccauuucaucuggggaccaagcaagugugcauagcauggucaagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccaguaguagccauugcuuggauccaaacaaugaggaagguggucauggagugaaaggcugggccuuugaugauggaaaugacguguggaugggaagaacgaucagcgagagguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcacaucagguacauauggaacaggcucauggccugauggggcggacaucaaucucaugccuauauaa

SEQ ID NO: 53761 - RNA, 1410 nt, Artificial Sequence
  neuraminidase__InfluenzaA__AFY24219
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaccggacccuauugaugaaugaguuggguguuccauuucaucuggggaccaagcaagugugcauagcauggucaagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 53762 - RNA, 1410 nt, Artificial Sequence
  neuraminidase__InfluenzaA__AGB12978
augaauccaaaccaaaggauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuagacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53763 - RNA, 1410 nt, Artificial Sequence
  neuraminidase__InfluenzaA__AGB12989
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucaaacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53764 - RNA, 1410 nt, Artificial Sequence; identical to SEQ ID NO: 51329
  neuraminidase__InfluenzaA__AGB13009

SEQ ID NO: 53765 - RNA, 1410 nt, Artificial Sequence; identical to SEQ ID NO: 51329
  neuraminidase__InfluenzaA__AGB13019

SEQ ID NO: 53766 - RNA, 1410 nt, Artificial Sequence; identical to SEQ ID NO: 51513
  neuraminidase__InfluenzaA__AGB13029

SEQ ID NO: 53767 - RNA, 1410 nt, Artificial Sequence
  neuraminidase__InfluenzaA__AGB13039
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauucuucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagguuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaauggcucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53768 - RNA, 1410 nt, Artificial Sequence
  neuraminidase__InfluenzaA__AGB13051
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaacuuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53769 - RNA, 1410 nt, Artificial Sequence
  neuraminidase__InfluenzaA__AGB13069
augaauccaaaccaaaagauaauaaccauugguucgaucuguaugacaauuggaauggcuaacuuaauauuacaaauuggaaacauaaucucaauauggauuagccacucaauucaacuugggaaucaaaaucaaauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggauaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 53770 - RNA, 1410 nt, Artificial Sequence
  neuraminidase__InfluenzaA__AGB13074
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggcuuccgugaaauuagcgggcaauucuucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53771 - RNA, 1410 nt, Artificial Sequence
  neuraminidase__InfluenzaA__AGB13115
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuuguccuaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucaguagcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcguggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaauuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53772 - RNA, 1410 nt, Artificial Sequence; identical to SEQ ID NO: 51329
  neuraminidase__InfluenzaA__AGB13133

SEQ ID NO: 53773 - RNA, 1410 nt, Artificial Sequence
  neuraminidase__InfluenzaA__AGB13152
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuggcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53774 - RNA, 1410 nt, Artificial Sequence; identical to SEQ ID NO: 51098
  neuraminidase__InfluenzaA__AGB13162

SEQ ID NO: 53775 - RNA, 1410 nt, Artificial Sequence
  neuraminidase__InfluenzaA__AGB13173
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaauaacacuuggguaaaucagacauauguuaacaucagcaacaccaacuuugcugcuggacagucagugguuuccgugaaauuagcgggcaauuccucucucugcccuguuagugggugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucgagaaaagguuuugagaugauuugggauccaaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaauuaa

SEQ ID NO: 53776 - RNA, 1410 nt, Artificial Sequence
  neuraminidase__InfluenzaA__AGB13183
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggccaagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaaggcuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53777 - RNA, 1410 nt, Artificial Sequence; identical to SEQ ID NO: 51513
  neuraminidase__InfluenzaA__AGB13193

SEQ ID NO: 53778 - RNA, 1410 nt, Artificial Sequence
  neuraminidase__InfluenzaA__AGB13203
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53779 - RNA, 1410 nt, Artificial Sequence
  neuraminidase__InfluenzaA__AGB13213
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53780 - RNA, 1410 nt, Artificial Sequence
  neuraminidase__InfluenzaA__AGB13223
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcugacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagaaaacacaaucuggacuagcgggagcagcauauccuuuugugguguaaacagugacacuguggguuggucuuggccagacggugcugaguugccauuuaccauugacaaguaa

SEQ ID NO: 53781 - RNA, 1410 nt, Artificial Sequence; identical to SEQ ID NO: 51513
  neuraminidase__InfluenzaA__AGB13233

SEQ ID NO: 53782 - RNA, 1410 nt, Artificial Sequence
  neuraminidase__InfluenzaA__AGB13243
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaggggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53783 - RNA, 1410 nt, Artificial Sequence
  neuraminidase__InfluenzaA__AGB13253
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaacaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53784 - RNA, 1410 nt, Artificial Sequence
  neuraminidase__InfluenzaA__AGB13263
augaauccaaaccaaaagauaauaaccauugguucggucuguaugacaauuggaauggcuaacuuaauauuacaaauuggaaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcaggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugaugguaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaagccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcggcccaaagagaacacaaucuggacuagcgggagcagcauauccuuuugugguguaaacagugacacuguggguuggucuuggccagacggugcugaguugccauuuaccguugacaaguaa

SEQ ID NO: 53785 - RNA, 1410 nt, Artificial Sequence; identical to SEQ ID NO: 51309
  neuraminidase__InfluenzaA__AGB13273

SEQ ID NO: 53786 - RNA, 1410 nt, Artificial Sequence
  neuraminidase__InfluenzaA__AGB13283
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagcgggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaagagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53787 - RNA, 1410 nt, Artificial Sequence
  neuraminidase__InfluenzaA__AGB13293
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaauaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucaacauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53788 - RNA, 1410 nt, Artificial Sequence
  neuraminidase__InfluenzaA__AGB13303
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaccagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggccguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53789 - RNA, 1410 nt, Artificial Sequence
  neuraminidase__InfluenzaA__AGB13313
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgcgaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguagggauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 53790 - RNA, 1410 nt, Artificial Sequence; identical to SEQ ID NO: 51329
  neuraminidase__InfluenzaA__AGB13323

SEQ ID NO: 53791 - RNA, 1410 nt, Artificial Sequence
  neuraminidase__InfluenzaA__AGB13333
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagcgguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugaggacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53792 - RNA, 1410 nt, Artificial Sequence
  neuraminidase__InfluenzaA__AGB13343
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 53793 - RNA, 1410 nt, Artificial Sequence
  neuraminidase__InfluenzaA__AGB13353
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaauggcucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53794 - RNA, 1410 nt, Artificial Sequence
  neuraminidase__InfluenzaA__AGB13363
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacaccuggguaaaucagacauauguuaacaucagcaacaccaacuuugcugcuggacagucaguggcuuccgugaaauuagcgggcaauuccucucucugcucuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgaacccuaaugagcugcccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggagcuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53795 - RNA, 1410 nt, Artificial Sequence
  neuraminidase__InfluenzaA__AGB13383
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcagugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53796 - RNA, 1410 nt, Artificial Sequence
  neuraminidase__InfluenzaA__AGB13393
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauugcauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53797 - RNA, 1410 nt, Artificial Sequence
  neuraminidase__InfluenzaA__AGB13403
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauacguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucauguucccccuuggaaugcaggaccuucuucuugacucaaggggccuugcuaaaugacaaacauuccaauggaaccauuaaagacaggagcccauaucgaacucuaaugagcuguccuauuggugaaguucccucuccauacaacucaagauuugaaucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaguaaagcaagauaucauaggaauaaaugaguggucaggauauagcgggaguuuuguucagcauccagaacuaacagggcuggauuguauaagaccuugcuucuggguugagcuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 53798 - RNA, 1410 nt, Artificial Sequence
  neuraminidase__InfluenzaA__AGB13413
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccagugucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53799 - RNA, 1410 nt, Artificial Sequence
  neuraminidase__InfluenzaA__AGB13423
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucaugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53800 - RNA, 1410 nt, Artificial Sequence; identical to SEQ ID NO: 51461
  neuraminidase__InfluenzaA__AGB13433

SEQ ID NO: 53801 - RNA, 1410 nt, Artificial Sequence
  neuraminidase__InfluenzaA__AGB13443
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauacguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucauguucccccuuggaaugcaggaccuucuucuugacucaaggggccuugcuaaaugacaaacauuccaauggaaccauuaaagacaggagcccauaucgaacucuaaugagcuguccuauuggugaaguucccucuccauacaacucaagauuugaaucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaguaaagcaagauaucauaggaauaaaugaguggucaggauauagcgggaguuuuguucagcauccagaacuaacagggcuggauuguauaagaccuugcuucuggguugagcuaaucagagggcggccuaaagagaacacaaucuggacuagcgggagcagcauauccuuuugugguguaaacagugacacuguggguuggucuuggccagacggugcugaguugccauuuaccauugacaaguaa

SEQ ID NO: 53802 - RNA, 1410 nt, Artificial Sequence
  neuraminidase__InfluenzaA__AGB13453
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcuuuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53803 - RNA, 1410 nt, Artificial Sequence; identical to SEQ ID NO: 51094
  neuraminidase__InfluenzaA__AGB13463

SEQ ID NO: 53804 - RNA, 1410 nt, Artificial Sequence; identical to SEQ ID NO: 51513
  neuraminidase__InfluenzaA__AGB13473

SEQ ID NO: 53805 - RNA, 1410 nt, Artificial Sequence
  neuraminidase__InfluenzaA__AGB13483
augaauccaaaccaaaagauaauaaccauugguucggucuguaugacaauuggaauggcuaacuuaauauuacaaauuggaaacauaaucucaauauggauuagccacucaauccaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaaaaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcaacccaaagagaacacaaucuggacuagcgggagcagcauauccuuuugugguguaaacagugacacuguggguuggucuuggccagacggugcugaguugccauuuaccauugacaaguaa

SEQ ID NO: 53806 - RNA, 1410 nt, Artificial Sequence
  neuraminidase__InfluenzaA__AGB13493
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53807 - RNA, 1410 nt, Artificial Sequence; identical to SEQ ID NO: 51294
  neuraminidase__InfluenzaA__AGB13503

SEQ ID NO: 53808 - RNA, 1410 nt, Artificial Sequence; identical to SEQ ID NO: 51497
  neuraminidase__InfluenzaA__AGB13513

SEQ ID NO: 53809 - RNA, 1410 nt, Artificial Sequence; identical to SEQ ID NO: 51496
  neuraminidase__InfluenzaA__AGB13523

SEQ ID NO: 53810 - RNA, 1410 nt, Artificial Sequence
  neuraminidase__InfluenzaA__AGB13533
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauauaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgccccaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacuaggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53811 - RNA, 1410 nt, Artificial Sequence
  neuraminidase__InfluenzaA__AGB13543
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagcgcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53812 - RNA, 1410 nt, Artificial Sequence
  neuraminidase__InfluenzaA__AGB13553
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaauugccauuuaccauugacaaguaa

SEQ ID NO: 53813 - RNA, 1410 nt, Artificial Sequence
  neuraminidase__InfluenzaA__AGB13563
augaauccaaaccaaaagauaauaaccauugguucggucuguaugacaauuggaguggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaacuuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaaacauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53814 - RNA, 1410 nt, Artificial Sequence; identical to SEQ ID NO: 51329
  neuraminidase__InfluenzaA__AGB13573

SEQ ID NO: 53815 - RNA, 1410 nt, Artificial Sequence
  neuraminidase__InfluenzaA__AGB13583
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggguuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53816 - RNA, 1410 nt, Artificial Sequence
  neuraminidase__InfluenzaA__AGB13593
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacaaucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53817 - RNA, 1410 nt, Artificial Sequence; identical to SEQ ID NO: 51513
  neuraminidase__InfluenzaA__AGB13603

SEQ ID NO: 53818 - RNA, 1410 nt, Artificial Sequence
  neuraminidase__InfluenzaA__AGB13613
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcugugcuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53819 - RNA, 1410 nt, Artificial Sequence
  neuraminidase__InfluenzaA__AGB13623
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguuuuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53820 - RNA, 1410 nt, Artificial Sequence
  neuraminidase__InfluenzaA__AGB13633
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcugugcuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccagacggugcugaguugccauuuaccauugacaaguaa

SEQ ID NO: 53821 - RNA, 1410 nt, Artificial Sequence
  neuraminidase__InfluenzaA__AGB13643
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauacguuaacaucagcaacaccaacuuugcugcuggacagucagugguuuccgugaaauuagcgggcaauuccucucucugcccuguuaguggaugggcuauauacaguaaagacaacgguauaagaaucgguuccaagggggauguguuugucauaagggaaccauucauaucauguucccccuuggaaugcaggaccuucuucuugacucaaggggccuugcuaaaugacaaacauuccaauggaaccauuaaagacaggagcccauaucgaacucuaaugagcuguccuauuggugaaguucccucuccauacaacucaagauuugaaucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaauguguauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaguaaagcaagauaucauaggaauaaaugaguggucaggauauagcgggaguuuuguucagcauccagagcuaacagggcuggauuguauaagaccuugcuucuggguugagcuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 53822 - RNA, 1410 nt, Artificial Sequence
  neuraminidase__InfluenzaA__AGB13653
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauacguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucauguucccccuuggaaugcaggaccuucuucuugacucaaggggccuugcuaaaugacaaacauuccaauggaaccauuaaagacaggagcccauaucgaacucuaaugagcugcccuauuggugaaguucccucuccauacaacucaagauuugaaucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaauguguauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaguaaagcaagauaucauaggaauaaaugaguggucaggauauagcgggaguuuuguucagcauccagagcugacagggcuggauuguauaagaccuugcuucuggguugagcuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 53823 - RNA, 1410 nt, Artificial Sequence; identical to SEQ ID NO: 51098
  neuraminidase__InfluenzaA__AGB13663

SEQ ID NO: 53824 - RNA, 1410 nt, Artificial Sequence; identical to SEQ ID NO: 51094
  neuraminidase__InfluenzaA__AGB13724

SEQ ID NO: 53825 - RNA, 1410 nt, Artificial Sequence; identical to SEQ ID NO: 51329
  neuraminidase__InfluenzaA__AGB13734

SEQ ID NO: 53826 - RNA, 1410 nt, Artificial Sequence; identical to SEQ ID NO: 47718
  neuraminidase__InfluenzaA__AGB51359

SEQ ID NO: 53827 - RNA, 1410 nt, Artificial Sequence
  neuraminidase__InfluenzaA__AGB97270
augaauccaaaccaaaagauaauaaccauugguucggucuguaugacaauuggaauggcuaacuuaauauuacaaauuggaaacauaaucucaauauggauuagccacucaauucaacuuaggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaauggcuguguuaaaguacaacggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgccccaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 53828 - RNA, 1410 nt, Artificial Sequence
  neuraminidase__InfluenzaA__AGB97274
augaauccaaaccaaaagauaauaaccauugguucggucuguaugacaauuggaauggcuaacuuaauauuacaaauuggaaacauaaucucaauauggauuagccacucaauucaacuuaggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgccccaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 53829 - RNA, 1410 nt, Artificial Sequence
  neuraminidase__InfluenzaA__AGB97289
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53830 - RNA, 1410 nt, Artificial Sequence
  neuraminidase__InfluenzaA__AGE15475
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaacuuucuucuugacucaaggguccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaaaaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauuacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuagcauugacaaguaa

SEQ ID NO: 53831 - RNA, 1410 nt, Artificial Sequence
  neuraminidase__InfluenzaA__AGE15476
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggguccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuagaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauuacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53832 - RNA, 1410 nt, Artificial Sequence
  neuraminidase__InfluenzaA__AGE15477
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccccuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 53833 - RNA, 1410 nt, Artificial Sequence
  neuraminidase__InfluenzaA__AGE15478
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggguccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuagaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauuauuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaaaagugacacuguggguuggucuuggccagacggugcugaguugccauuuaccauugacaaguaa

SEQ ID NO: 53834 - RNA, 1410 nt, Artificial Sequence
  neuraminidase__InfluenzaA__AGE15479
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaacuuucuucuugacucaaggguccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaauugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauuacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53835 - RNA, 1410 nt, Artificial Sequence; identical to SEQ ID NO: 53832
  neuraminidase__InfluenzaA__AGE15480

SEQ ID NO: 53836 - RNA, 1410 nt, Artificial Sequence; identical to SEQ ID NO: 51497
  neuraminidase__InfluenzaA__AGE89270

SEQ ID NO: 53837 - RNA, 1410 nt, Artificial Sequence
  neuraminidase__InfluenzaA__AGE89280
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguaguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuacuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaccgaccgugggugucuuucaaccagaaucuggaauaucagauaggauacauaugcagugggauuuucggagacaauccacguccuaaugacaagacaggcaguugugguccaguaucgucuaauggagcaaauggaguaaaaggauuuucauucaaauacggcaaugguguuuggauagggagaacuaaaagcauuaguucaagaaacggguuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53838 - RNA, 1410 nt, Artificial Sequence
  neuraminidase__InfluenzaA__AGE89290
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaaguuugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguauaguaguaaugacugaugggagugcuucaggaaaagcugauacuaaaauacuauucguugaggaggggaaaaucguucauacuagcacauugucaggaagugcucagcaugucgaggagugcucuugcuauccucgauauccuggugucagaugugucugcagagacaacuggaaaggcuccaauaggcccauaguagauauaaacauaaaggaucauagcauuauuuccaguuauguauguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaggaggaaacugaagucuuguggaccucaaacaguauuguuguguuuuguggcaccucagguacauauggaacaggcucauggccugauggggcggaccucaaucucaugccuauauaa

SEQ ID NO: 53839 - RNA, 1410 nt, Artificial Sequence
  neuraminidase__InfluenzaA__AGE89301
augaauccaaaccaaaagauaauaaccauugguucggucuguaugacaauuggaauggcuaacuuaauauuacaaauuggaaacauaaucucaauauggauuagccacucaauccaacuugggaaucaaagucagauugaaacaugcaaucaaagcgucauuacuuaugaaaacaacacuuggguaaaucagacauauguuaacaucagcaacaccaauuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53840 - RNA, 1410 nt, Artificial Sequence
  neuraminidase__InfluenzaA__AGE89311
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugaugguaucaauuggcuaacaauuggaauuucuggcccagacaauggggcaguggcuguguuaaaguacaacggcauaauaacagacacuaucaagaguuggaaaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggacccgaacggauggacugggacagacaauaacuucucaaaaaagcaagauaucauaggaauaaaugaguggucaggauauagcgggaguuuuguucagcauccagaacuaacagggcuggauuguauaagaccuugcuucuggguugaacuaaucagagggcggcccaaagagaacacaaucuggacuagcgggagcagcauguccuuuugugguguaaacagugacacuguggguuggucuuggccagacggugcugaguugccauuuaccauugacaaguaa

SEQ ID NO: 53841 - RNA, 1410 nt, Artificial Sequence; identical to SEQ ID NO: 52303
  neuraminidase__InfluenzaA__AGE89321

SEQ ID NO: 53842 - RNA, 1410 nt, Artificial Sequence
  neuraminidase__InfluenzaA__AGE89332
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaaacaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguugaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaggaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuauggaccucaaacaguauuguuguguuuuguggcaccucagguacauauggaacaggcucauggccugauggggcggaccucaaucucaugccuauauaa

SEQ ID NO: 53843 - RNA, 1410 nt, Artificial Sequence
  neuraminidase__InfluenzaA__AGE89343
augaauccaaaccaaaagauaauaaccauugguucggucuguaugacaauuggaauggcuaacuuaauauuacaaauuggaaacauaaucucaauauggauuagccacucaauucaacuugggaaucaaagucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccauuggaaugcagaaccuucuuuuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53844 - RNA, 1410 nt, Artificial Sequence
  neuraminidase__InfluenzaA__AGE89353
augaauccaaaucaaaagauaauaacgauuggcucaguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaucaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgaugggaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53845 - RNA, 1410 nt, Artificial Sequence
  neuraminidase__InfluenzaA__AGE89364
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53846 - RNA, 1410 nt, Artificial Sequence
  neuraminidase__InfluenzaA__AGE89374
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggcgucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53847 - RNA, 1410 nt, Artificial Sequence
  neuraminidase__InfluenzaA__AGE89385
augaauccaaaccaaaagauaauaaccauugguucggucuguaugacaauuggaauggcuaacuuaauauugcaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggcuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagagauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53848 - RNA, 1410 nt, Artificial Sequence
  neuraminidase__InfluenzaA__AGE89395
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53849 - RNA, 1410 nt, Artificial Sequence; identical to SEQ ID NO: 51497
  neuraminidase__InfluenzaA__AGE89425

SEQ ID NO: 53850 - RNA, 1410 nt, Artificial Sequence
  neuraminidase__InfluenzaA__AGE89722
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugauagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53851 - RNA, 1410 nt, Artificial Sequence
  neuraminidase__InfluenzaA__AGE89733
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauauggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53852 - RNA, 1410 nt, Artificial Sequence
  neuraminidase__InfluenzaA__AGE89743
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacuccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagauaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53853 - RNA, 1410 nt, Artificial Sequence
  neuraminidase__InfluenzaA__AGE89754
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggaaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53854 - RNA, 1410 nt, Artificial Sequence; identical to SEQ ID NO: 52291
  neuraminidase__InfluenzaA__AGE89765

SEQ ID NO: 53855 - RNA, 1410 nt, Artificial Sequence
  neuraminidase__InfluenzaA__AGG13414
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacagcgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaagcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53856 - RNA, 1410 nt, Artificial Sequence
  neuraminidase__InfluenzaA__AGG13426
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53857 - RNA, 1410 nt, Artificial Sequence; identical to SEQ ID NO: 53829
  neuraminidase__InfluenzaA__AGG13438

SEQ ID NO: 53858 - RNA, 1410 nt, Artificial Sequence
  neuraminidase__InfluenzaA__AGG13498
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagaaaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacuccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuugugcgguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccgaaguccaaauugcagauaaauaggcaagucauaguugacagagguaauagguccgguuauucugguauuuucucuguugaaggcaaaaacugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 53859 - RNA, 1410 nt, Artificial Sequence; identical to SEQ ID NO: 53829
  neuraminidase__InfluenzaA__AGG13510

SEQ ID NO: 53860 - RNA, 1410 nt, Artificial Sequence
  neuraminidase__InfluenzaA__AGG13522
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacuccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuugugcgguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccgaaguccaaauugcagauaaauaggcaagucauaguugacagagguaauagguccgguuauucugguauuuucucuguugaaggcaaaaacugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 53861 - RNA, 1410 nt, Artificial Sequence
  neuraminidase__InfluenzaA__AGG13534
augaauccaaaucaaaagauaauaacaauuggcucuguuucucucaccauuuccacaguaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53862 - RNA, 1410 nt, Artificial Sequence
  neuraminidase__InfluenzaA__AGG13546
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggagaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaagugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53863 - RNA, 1410 nt, Artificial Sequence
  neuraminidase__InfluenzaA__AGG13558
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagaaugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53864 - RNA, 1410 nt, Artificial Sequence; identical to SEQ ID NO: 53829
  neuraminidase__InfluenzaA__AGG13570

SEQ ID NO: 53865 - RNA, 1410 nt, Artificial Sequence
  neuraminidase__InfluenzaA__AGG13582
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaggauaaaaaugcaacugcuagcuucauuuacaaugggaggcuuguagauaguguuguuucaugguccaaagaaacucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53866 - RNA, 1410 nt, Artificial Sequence
  neuraminidase__InfluenzaA__AGG13606
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaacgaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53867 - RNA, 1410 nt, Artificial Sequence
  neuraminidase__InfluenzaA__AGG13618
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauuuguguucaggacuuguuggagacacacccagaaaaaacgacggcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaaaucauaguugacagaggugauagguccgguuauucugguauuuucucuguugaaggcaaaagcugcaucaaucggugcuuuuauguggaguugauuaggggaagaaaagaggaaacugaaguuuuguggaccucaaacaguauuguuguguuuuguggcaccucagguacauauggaacaggcucauggccugauggggcggaccucaaucucaugccuauauaa

SEQ ID NO: 53868 - RNA, 1410 nt, Artificial Sequence
  neuraminidase__InfluenzaA__AGG13630
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaggauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53869 - RNA, 1410 nt, Artificial Sequence; identical to SEQ ID NO: 53866
  neuraminidase__InfluenzaA__AGG13642

SEQ ID NO: 53870 - RNA, 1410 nt, Artificial Sequence
  neuraminidase__InfluenzaA__AGG13654
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacuccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuugugcgguaguaaugacugaugggagugcuucaggaaaagcugauacuaaaauacuauucauugaggaggggaaaaucguucagacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccgaaguccaaauugcagauaaauaggcaagucauaguugacagagguaauagguccgguuauuccgguauuuucucuguugaaggcaaaaacugcaucaaucggugcuuuuauguggaguugauuaggggaaggaaagaggaaauugaagucuuguggaccucaaacaguauuguuguguuuuguggcaccucagguacauauggaacaggcucauggccugauggggcggaccucaaucucaugccuauauaa

SEQ ID NO: 53871 - RNA, 1410 nt, Artificial Sequence
  neuraminidase__InfluenzaA__AGG13666
augaauccaaaucaaaagauaauaacaauuggcucuguuucucucaccauuuccacaguaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53872 - RNA, 1410 nt, Artificial Sequence
  neuraminidase__InfluenzaA__AGG13678
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguauaucugaccaacaccaccauagagaaggaaauaugccccaaaccagcagaauacagaaauuggucaaaaccgcaauguggcauuacaggauuugcaccuuuaucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaagguuccaaucggcccaucguagauauaaacauaaaggaucauagcauuguuuccaguuauguguguucaggacuuguuggagacacacccagaaaaaacgacagcuccagcaguagccauuguuuggguccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaaccgaagucuuguggaccucaaacaguauuguuguguuuuguggcaccgcagguacauauggaacaggcucauggccugauggggcggaccucaaucucaugccuauauaa

SEQ ID NO: 53873 - RNA, 1410 nt, Artificial Sequence; identical to SEQ ID NO: 53829
  neuraminidase__InfluenzaA__AGG13690

SEQ ID NO: 53874 - RNA, 1410 nt, Artificial Sequence
  neuraminidase__InfluenzaA__AGG13702
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaaaugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53875 - RNA, 1410 nt, Artificial Sequence; identical to SEQ ID NO: 53860
  neuraminidase__InfluenzaA__AGG13714

SEQ ID NO: 53876 - RNA, 1410 nt, Artificial Sequence; identical to SEQ ID NO: 53829
  neuraminidase__InfluenzaA__AGG13726

SEQ ID NO: 53877 - RNA, 1410 nt, Artificial Sequence; identical to SEQ ID NO: 53829
  neuraminidase__InfluenzaA__AGG13738

SEQ ID NO: 53878 - RNA, 1410 nt, Artificial Sequence
  neuraminidase__InfluenzaA__AGG13750
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuacccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53879 - RNA, 1410 nt, Artificial Sequence
  neuraminidase__InfluenzaA__AGG13762
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53880 - RNA, 1410 nt, Artificial Sequence
  neuraminidase__InfluenzaA__AGG13774
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaacaauagaaagaaacauaacagagauaguguaucuaaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacuccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuugugcgguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccgaaguccaaauugcagauaaauaggcaagucauaguugacagagguaauagguccgguuauucugguauuuucucuguugaaggcaaaaacugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 53881 - RNA, 1410 nt, Artificial Sequence
  neuraminidase__InfluenzaA__AGG13786
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacuugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53882 - RNA, 1410 nt, Artificial Sequence
  neuraminidase__InfluenzaA__AGG13798
augaacccaaaucaaaagauaauaacgauuggcucuguuucucucaccauuuccacaauaugcuucuucaugcaaauugccaucuugauaacuacuguaacauugcauuucaagcaauaugaauucaacuccccuccaaacaaccaagugaugcugugugaaccaacaauaauagaaagaaacauaacagagauaguguaucuaaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacuccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuugugcgguaguaaugacugaugggagugcuucaggaaaagcugauacuaaaauauuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccgaaguccaaauugcagauaaauaggcaagucauaguugacagagguaauagguccgguuauucugguauuuucucuguugaaggcaaaaacugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 53883 - RNA, 1410 nt, Artificial Sequence
  neuraminidase__InfluenzaA__AGG13810
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggguccuaacaaugaagaagguggucauggagugaaaggcugggccuucgaugauggaaaugacguguggaugggaagaacgauuaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53884 - RNA, 1410 nt, Artificial Sequence; identical to SEQ ID NO: 53860
  neuraminidase__InfluenzaA__AGG13822

SEQ ID NO: 53885 - RNA, 1410 nt, Artificial Sequence; identical to SEQ ID NO: 53860
  neuraminidase__InfluenzaA__AGG13834

SEQ ID NO: 53886 - RNA, 1410 nt, Artificial Sequence
  neuraminidase__InfluenzaA__AGG13846
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcaugucuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53887 - RNA, 1410 nt, Artificial Sequence; identical to SEQ ID NO: 53829
  neuraminidase__InfluenzaA__AGG13858

SEQ ID NO: 53888 - RNA, 1410 nt, Artificial Sequence
  neuraminidase__InfluenzaA__AGG13870
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacagguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcacaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53889 - RNA, 1410 nt, Artificial Sequence
  neuraminidase__InfluenzaA__AGG13894
augaauccaaaucaaaagauaauaacaauuggcucuguuucucucaccauuuccacaguaugcuucuucaugcaaauugccaucuugauaacuacuguaacauugcauuucaagcaauaugaauucaacucccccccaaacaaccaagugaugcugugugaaccaacaauaauagaaagaaacguaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53890 - RNA, 1410 nt, Artificial Sequence; identical to SEQ ID NO: 53860
  neuraminidase__InfluenzaA__AGG13906

SEQ ID NO: 53891 - RNA, 1410 nt, Artificial Sequence
  neuraminidase__InfluenzaA__AGG13930
augaauccaaaucaaaagauaauaacgauuggcucuguuucucucaccauuuccacaauaugcuucuucaugcaaauugccaucuugauaacuacuguaacguugcauuucaagcaauaugaauucaacucccccccaaacaaccaagugaugcugugugaaccgacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgaccgcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53892 - RNA, 1410 nt, Artificial Sequence; identical to SEQ ID NO: 53868
  neuraminidase__InfluenzaA__AGG13942

SEQ ID NO: 53893 - RNA, 1410 nt, Artificial Sequence
  neuraminidase__InfluenzaA__AGG13965
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucaguaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguugcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagaaaacacaaucuggacuagcgggagcagcauauccuuuugugguguaaacagugacacuguggguuggucuuggccagacggugcugaguugccauuuaccauugacaaguaa

SEQ ID NO: 53894 - RNA, 1410 nt, Artificial Sequence; identical to SEQ ID NO: 53871
  neuraminidase__InfluenzaA__AGG13976

SEQ ID NO: 53895 - RNA, 1410 nt, Artificial Sequence
  neuraminidase__InfluenzaA__AGG13988
augaauccaaaucaaaagauaauaacgauuggcucuguuucucucaccauuuccacaguaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaaugggacuuguacaguaguaaugacugauggaagugcuucaggaaaagcugauacuaaaauacuauucauugaggaggggaaaaucguucauacuagcaccuugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53896 - RNA, 1410 nt, Artificial Sequence
  neuraminidase__InfluenzaA__AGG14000
augaauccaaaucaaaagauaauaacgauuggcucuguuucucucaccauuuccacaguaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaaugggacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53897 - RNA, 1410 nt, Artificial Sequence; identical to SEQ ID NO: 53871
  neuraminidase__InfluenzaA__AGG14012

SEQ ID NO: 53898 - RNA, 1410 nt, Artificial Sequence; identical to SEQ ID NO: 53886
  neuraminidase__InfluenzaA__AGG14024

SEQ ID NO: 53899 - RNA, 1410 nt, Artificial Sequence
  neuraminidase__InfluenzaA__AGG14036
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugcccuaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacuccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuugugcgguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauauguguucaggacuuguuggagacacacccagaaaaaacgacagcuccagcaguggccauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccgaaguccaaauugcagauaaauaggcaagucauaguugacagagguaauagguccgguuauucugguauuuucucuguugaaggcaaaaacugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 53900 - RNA, 1410 nt, Artificial Sequence; identical to SEQ ID NO: 53879
  neuraminidase__InfluenzaA__AGG14321

SEQ ID NO: 53901 - RNA, 1410 nt, Artificial Sequence; identical to SEQ ID NO: 53829
  neuraminidase__InfluenzaA__AGG14333

SEQ ID NO: 53902 - RNA, 1410 nt, Artificial Sequence
  neuraminidase__InfluenzaA__AGG84182
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagaaauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 53903 - RNA, 1398 nt, Artificial Sequence
  neuraminidase__InfluenzaA__AGJ51955
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaaguguuguggaccggcgauaguauaguaucgauguguuccaguacagaauuccugggacaauggaacuggccugauggggcuaaaauagaguacuuccucuaa

SEQ ID NO: 53904 - RNA, 1398 nt, Artificial Sequence
  neuraminidase__InfluenzaA__AGJ72863
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaggugauacguggaagacccaaggaggauaaaguguggugggccggcaauaguauaguaucgauguguuccaguacagaauuccugggacaauggaacuggccugauggggcuaaaauagaguacuuccucuaa

SEQ ID NO: 53905 - RNA, 1410 nt, Artificial Sequence
  neuraminidase__InfluenzaA__AGJ73328
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacagaagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggaaugggacagacaauaacuucucaauaaagcaagauauuguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53906 - RNA, 1410 nt, Artificial Sequence
  neuraminidase__InfluenzaA__AGJ73330
augaauccaaaccaaaagauaauaaccauugguucggucuguaugacaauuggaauggcuaacuuaauauuacaaauuggaaacauaaucucaauauggauuagccacucaauucaacuugggaaucaaagucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53907 - RNA, 1410 nt, Artificial Sequence
  neuraminidase__InfluenzaA__AGJ73332
augaauccaaaccaaaagauaauaaccauugguucggucuguaugacaauuggaauggcuaacuuaauauuacaaauuggaaacauaaucucaauauggauuagccacucaauucaacuugggaaucaaaaucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccugcuaaaugacaaacauuccaauggaaccauuaaagacagaagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccauaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugaaaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53908 - RNA, 1410 nt, Artificial Sequence; identical to SEQ ID NO: 53906
  neuraminidase__InfluenzaA__AGJ73334

SEQ ID NO: 53909 - RNA, 1410 nt, Artificial Sequence
  neuraminidase__InfluenzaA__AGJ73336
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuagaaugcagaaccuucuucuugacucaaggggccuuguuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53910 - RNA, 1410 nt, Artificial Sequence
  neuraminidase__InfluenzaA__AGJ73338
augaauccaaaccaaaagauaauaaccauugguucggucuguaugacaauuggaauggcuaacuuaauauuacaaauuggaaacauaaucucaauauggauuagccacucaauucaacuugggaaucaaagucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaaugggaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53911 - RNA, 1410 nt, Artificial Sequence
  neuraminidase__InfluenzaA__AGJ73340
augaauccaaaccaaaagauaauaaccauugguucggucuguaugacaauuggaauggcuaacuuaauauuacaaauuggaaacauaaucucaauauggauuagccacucaauucaacuugggaaucaaagucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccugcuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53912 - RNA, 1410 nt, Artificial Sequence
  neuraminidase__InfluenzaA__AGJ73342
augaauccaaaccaaaagauaauaaccauugguucggucuguaugacaauuggaauggcuaacuuaauauuacaaauuggaaacauaaucucaauauggauuagccacucaauucaacuugggaaucaaagucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacaguggcacuguggguuggucuuggccagacggugcugaguugccauuuaccauugacaaguaa

SEQ ID NO: 53913 - RNA, 1410 nt, Artificial Sequence
  neuraminidase__InfluenzaA__AGJ73344
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53914 - RNA, 1410 nt, Artificial Sequence
  neuraminidase__InfluenzaA__AGJ73346
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaaaaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagagcacaaucuggacuagcgggagcagcauauccuuuugugguguaaacagugacacuguggguuggucuuggccagacggugcugaguugccauuuaccauugacaaguaa

SEQ ID NO: 53915 - RNA, 1410 nt, Artificial Sequence
  neuraminidase__InfluenzaA__AGJ73348
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugauuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53916 - RNA, 1410 nt, Artificial Sequence
  neuraminidase__InfluenzaA__AGJ73350
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacgaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucguaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53917 - RNA, 1410 nt, Artificial Sequence
  neuraminidase__InfluenzaA__AGJ73352
augaauccaaaccaaaagauaauaaccauugguucggucuguaugacaauuggaauggcuaacuuaauauuacaaauuggaaacauaaucucaauauggauuagccacucaauucaacuugggaaucaaagucaaauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaguccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53918 - RNA, 1410 nt, Artificial Sequence; identical to SEQ ID NO: 51309
  neuraminidase__InfluenzaA__AGJ73354

SEQ ID NO: 53919 - RNA, 1410 nt, Artificial Sequence
  neuraminidase__InfluenzaA__AGJ73356
augaauccaaaccaaaagauaauaaccauugguucggucuguaugacaauuggaauggcuaacuuaauauuacaaauuggaaacauaaucucaauauggauuagccacucaauucaacuugggaaucaaagucaaauugaaacaugcaaucaaagcgucauuacuuaugaaaacaacacuuggguaaaucagacauauuuuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53920 - RNA, 1410 nt, Artificial Sequence; identical to SEQ ID NO: 51329
  neuraminidase__InfluenzaA__AGJ73358

SEQ ID NO: 53921 - RNA, 1410 nt, Artificial Sequence
  neuraminidase__InfluenzaA__AGJ73360
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauucucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53922 - RNA, 1410 nt, Artificial Sequence
  neuraminidase__InfluenzaA__AGJ73362
augaauccaaaccaaaagauaauaaccauugguucggucuguaugacaauuggaauggcuaacuuaauauuacaaauuggaaacauaaucucaauauggauuagccacucaauucaacuugggaaucaaagucaaauugaaacaugcaaucaaagcgucauuacuuaugaaaacaacacuuggguaaaucagacauauguuaacaucagcaacaccaacuuugcugauggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53923 - RNA, 1410 nt, Artificial Sequence
  neuraminidase__InfluenzaA__AGJ73364
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggaaugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53924 - RNA, 1410 nt, Artificial Sequence; identical to SEQ ID NO: 51329
  neuraminidase__InfluenzaA__AGJ73366

SEQ ID NO: 53925 - RNA, 1410 nt, Artificial Sequence; identical to SEQ ID NO: 53906
  neuraminidase__InfluenzaA__AGJ73370

SEQ ID NO: 53926 - RNA, 1410 nt, Artificial Sequence
  neuraminidase__InfluenzaA__AGJ73372
augaauccaaaccaaaagauaauaaccauugguucggucuguaugacaauuggaauggcuaacuuaauauuacaaauuggaaacauaaucucaauauggauuagccacucaauucaacuugggaaucaaaaucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccauaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53927 - RNA, 1410 nt, Artificial Sequence; identical to SEQ ID NO: 53906
  neuraminidase__InfluenzaA__AGJ73374

SEQ ID NO: 53928 - RNA, 1410 nt, Artificial Sequence
  neuraminidase__InfluenzaA__AGJ73376
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauugggauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagauccucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaacaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53929 - RNA, 1410 nt, Artificial Sequence
  neuraminidase__InfluenzaA__AGJ73379
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53930 - RNA, 1410 nt, Artificial Sequence
  neuraminidase__InfluenzaA__AGJ73381
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguucgucauaagggaaccauucauaucaugcucccccuuggaaugcagaaccuucuucuugacucaaggggccuugcuaaaugacgaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 53931 - RNA, 1410 nt, Artificial Sequence
  neuraminidase__InfluenzaA__AGK62992
augaauccaaaucaaaagauaauaacgauuggcucuguuucucucaccauuuccacaauauguuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaagucaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53932 - RNA, 1410 nt, Artificial Sequence
  neuraminidase__InfluenzaA__AGK62996
augaauccaaaucaaaagauaauaacgauuggcucuguuucucucaucauuuccacaauauguuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucagggcuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaagcaaaagcugcaucaaucggugcuuuuauguggaauugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53933 - RNA, 1410 nt, Artificial Sequence
  neuraminidase__InfluenzaA__AGK62998
augaauccaaaucaaaagauaauaacgauuggcucuguuucucucaccauugccacaauaugcuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcagugugacauuacaggauuugcaccuuuuucuaaggacaauucgauuaggcuuuccgcugguggggacaucugggugacaagggaaccuuaugugucaugcgauccugacaaguguuaucaauuugcccuugggcagggaacaacacuaaacaacgugcauucaaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggauccaauaggcccaucguagauauaaacauaaaggaucauagcauugucuccaguuauguguguucaggacuucuuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaagcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53934 - RNA, 1410 nt, Artificial Sequence
  neuraminidase__InfluenzaA__AGK63000
augaauccaaaucaaaagauaauaacgauuggcucuguuucucucaccauugccacaauauguuucuucaugcaaauugccaucuugauaacuacuguaacauugcauuucaagcaaugugauuucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaauugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53935 - RNA, 1410 nt, Artificial Sequence
  neuraminidase__InfluenzaA__AGK63002
augaauccaaaucaaaagauaauaacgauuggcucuguuucucucaccauuuccacaauaugcuucuucaugcaaauugccaucuugaugacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauggcaugguccagcucaaguugucacgauggaaaagcauggcugcauguuuguauaacggggaaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcucuugcuauccucgauauccuggugucagaugugucugcagagacaacuggaaaggauccaauaggcccauuguagauauaaacauaaaggaucauagcauuguuuccaguuauguauguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaccgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaauugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53936 - RNA, 1410 nt, Artificial Sequence
  neuraminidase__InfluenzaA__AGK63004
augaauccaaaucaaaagauaauaacaauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaaguucucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaauugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53937 - RNA, 1410 nt, Artificial Sequence
  neuraminidase__InfluenzaA__AGK63006
augaauccaaaucaaaagauaauaacgauuggcucuguuucucucaccauugccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuugggcagggaacaacacuaaacaacgugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaaccuguacaguaguaaugacugauggaagugcuucagcaaaagcugauacuaaaauacuauucauugaggaggggaaaaucguucauacuagcacauugucaggaagugcucagcaugucgaggagugcucuugcuauccucgauauucuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaagucccaauugcagauaaauaggcaagucauaguugacagaggugauagguccgguuauucugguauuuucucuguugaaagcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53938 - RNA, 1410 nt, Artificial Sequence
  neuraminidase__InfluenzaA__AGK63008
augaauccaaaucaaaagauaauaacgauuggcucuguuucucucaccauugccacaauauguuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuacccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagaugaauaggcaagucauaguugacagaggugauagguccgguuauucugguauuuucucuguugaaggcaaaagcugcaucaaucggugcuuuuauguggaauugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53939 - RNA, 1410 nt, Artificial Sequence
  neuraminidase__InfluenzaA__AGK63010
augaauccaaaucaaaagauaauaacaauuggcucuguuucucucaccauugccacaauauguuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaagaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuacccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagucauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccgacccuaaguccaaauugcagauaaauaggcaagucauaguugacagaggugauagguccgguuauucugguauuuucucuguugaaggcaaaagcugcaucaaucggugcuuuuauguggaauugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53940 - RNA, 1410 nt, Artificial Sequence
  neuraminidase__InfluenzaA__AGK63012
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagucauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguuauagguccgguuauucugguauuuucucuguugaaggcaaaagcugcaucaaucggugcuuuuauguggacuugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53941 - RNA, 1410 nt, Artificial Sequence
  neuraminidase__InfluenzaA__AGK63014
augaauccaaaucaaaagauaauaacgauuggcucuguuucucucaccauuuccacaauauguuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacuuuauugaugaaugaguuagguguuccuuuuccucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccacaggacccaggagucagaaugcguguguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauugucuccaguuauguguguucuggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaagaaacugaagucuuguggaccucaaacaguauuguuguguuuuguggcaccucagguacauauggaacaggcucauggccugauggggcggacaucaaucucaugccuauauaa

SEQ ID NO: 53942 - RNA, 1410 nt, Artificial Sequence
  neuraminidase__InfluenzaA__AGK63018
augaauccaaaucaaaagauaauaacgauuggcucuguuucucucaccauuuccacaauaugcuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuacccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagucauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaauugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53943 - RNA, 1410 nt, Artificial Sequence
  neuraminidase__InfluenzaA__AGK63020
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53944 - RNA, 1410 nt, Artificial Sequence
  neuraminidase__InfluenzaA__AGK63022
augaauccaaaucaaaagauaauaacgauuggcucuguuucucucaccauuuccacaauaugcuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggacuugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53945 - RNA, 1410 nt, Artificial Sequence
  neuraminidase__InfluenzaA__AGK63024
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaauugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53946 - RNA, 1410 nt, Artificial Sequence
  neuraminidase__InfluenzaA__AGK63026
augaauccaaaucaaaagauaauaacuauuggcucuguuucucucaccauuuccacaauauguuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaauugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53947 - RNA, 1410 nt, Artificial Sequence
  neuraminidase__InfluenzaA__AGK63028
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaaaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaagucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaagccaaaagcugcaucauucggugcuuuuauguggaguugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53948 - RNA, 1410 nt, Artificial Sequence
  neuraminidase__InfluenzaA__AGK63030
augaauccaaaucaaaagauaauaacgauuggcucuguuucucucaccauuuccacaauauguuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcagugugacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuacccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaauugauuaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 53949 - RNA, 1410 nt, Artificial Sequence
  neuraminidase__InfluenzaA__AGK63032
augaauccaaaucaaaagauaauaacgauuggcucuguuucucucaccauuuccacaauauguuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauuccaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuacccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaccgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaauugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53950 - RNA, 1410 nt, Artificial Sequence
  neuraminidase__InfluenzaA__AGK63034
augaauccaaaucaaaagauaauaacgauuggcucuguuucucucaccauuuccacaauaugcuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcagugugacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaagaaugcaacugcuagcuucauuuacaaugggaagcuuguagauaguguugucucaugguccaaagaaauccucaggacccaggagucagaaugcguuuguaucaaugggacuuguacaguagugaugacugaugggagugcuucaggaaaagcugauacuaaaauacuauucauugaggaggggaaaaucguucauacuagcacauugucaggaagugcucagcaugucgaggagugcucuugcuacccucgauauccuggugucagaugugucugcagagacaacuggaaaggcuccaauaggcccaucguagauauaaacauaaagguucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaauugauuaggggaagaaaaaaggaaacugaagucuuguggaccucaaacaguauuguuguguuuuguggcaccucagguacauauggaacaggcucauggccugauggggcggacaucaaucucaugccuauauaa

SEQ ID NO: 53951 - RNA, 1410 nt, Artificial Sequence
  neuraminidase__InfluenzaA__AGK63036
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucagggcuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuucggguaugaaaccaucaaagucauugaaggcugguccaacccuaaguccaacuugcagauaaauaggcaagucauaguugacagagguaauagguccgguuauucugguauuuucucuguugaaggcaaaagcugcaucaaucggugcuuuuauguggaguugaucaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53952 - RNA, 1410 nt, Artificial Sequence
  neuraminidase__InfluenzaA__AGK63038
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaagaaugcaacugcuagcuucauuuacaaugggaagcuuguagauaguguugucucaugguccaaagaaauccucaggacccaggagucagaaugcguuuguaucaaugggacuuguacaguagugaugacugaugggagugcuucaggaaaagcugauacuaaaauacuauucauugaggaggggaaaaucguucauacuagcacauugucaggaagugcucagcaugucgaggagugcucuugcuacccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaaggugaucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaagcaaaagcugcaucaaucggugcuuuuauguggaauugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53953 - RNA, 1410 nt, Artificial Sequence
  neuraminidase__InfluenzaA__AGK63040
augaauccaaaucaaaagauaauaacgauuggcucuguuucucucaccauuuccacaauaugcuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuacccucgauauccuggugucagaugugucugcagagacaacuggaaaggcuccaauaggcccauuguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53954 - RNA, 1410 nt, Artificial Sequence
  neuraminidase__InfluenzaA__AGK63042
augaauccaaaucaaaagauaauaacgauuggcucuguuucucucaccauuuccacaauaugcuucuucaugcaaauugccaucuugauaacuacuguaacauugcauuucaagcaaugugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcagugugacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguaccuuuucaucuggggaccaagcaagugugcauggcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaauugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53955 - RNA, 1410 nt, Artificial Sequence
  neuraminidase__InfluenzaA__AGK63044
augaauccaaaucaaaagauaauaacgauuggcucuguuucucucaccauuuccacaauaugcuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcagugugacauuacaggauuugcaccuuuuucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguaccuuuucaucuggggaccaagcaagugugcauggcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuacccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguuauagguccgguuauucugguauuuucucuguugaaagcaaaagcugcaucaaucggugcuuuuauguggaauugcuuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53956 - RNA, 1410 nt, Artificial Sequence
  neuraminidase__InfluenzaA__AGK63046
augaauccaaaucaaaagauaauaacgauuggcucuguuucucucaccauuuccacaauaugcuucuucaugcaaauugccaucuugauaacuacuguaacauugcauuucaagcacuaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggaucccaacaaugaagaagguggucauggagugaaaggcugggccuuugaugauggaaaugacguguggaugggaagaacaaucaacgagacgucacgcuuaggguaugaaaccuucaaagucauugaaggcuggucaaacccuaaguccaaauugcagauaaauaggcaagucauaguugacagaggugauagguccgguuauucugguauuuucucuguugaaggcaaaagcugcaucaaucggugcuuuuauguggacuugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 53957 - RNA, 1398 nt, Artificial Sequence
  neuraminidase__InfluenzaA__AGK82159
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacgaaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 53958 - RNA, 1398 nt, Artificial Sequence
  neuraminidase__InfluenzaA__AGK84858
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 53959 - RNA, 1398 nt, Artificial Sequence
  neuraminidase__InfluenzaA__AGK84861
augaauccaaaucagaagauucuaugcacuucagccacugcuaucauaauaggcgcaaucgcaguacucauuggaauagcaaaccuaggauugaacauaggacugcaucuaaaaccgagcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugguucagauagauccaguagcaaugacacacacuagucaguauauaugcaguccuguucuuacagacaauccccgaccgaaugacccaaauauagguaaguguaaugacccuuauccagguauuaauaacaauggagucaagggauucucauaccuggauggggcuaacacuuggcuagggaggacaauaagcacagccucgaggucuggauacgagauguuaaaagugccaaaugcauugacagaugauagaucgaagcccauucaaggucagacaauuguauuaaacgcugacuggagugguuacaguggaucuuucauggacuauugggcugaaggggacugcuaucgagcguguuuuuauguggaguugauacgugggagacccaaggaggauaaagugugguggaccagcaauaguauaguaucgauguguuccaguacagaauuccugggacaauggaacuggccugauggggcuaaaauagaguacuuccucuaa

SEQ ID NO: 53960 - RNA, 1398 nt, Artificial Sequence; identical to SEQ ID NO: 53958
  neuraminidase__InfluenzaA__AGK84864

SEQ ID NO: 53961 - RNA, 1398 nt, Artificial Sequence
  neuraminidase__InfluenzaA__AGL95090
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaacaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcaaggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 53962 - RNA, 1413 nt, Artificial Sequence
  neuraminidase__InfluenzaA__AGL96802
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53963 - RNA, 1413 nt, Artificial Sequence
  neuraminidase__InfluenzaA__AGL96807
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcuugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacauuugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53964 - RNA, 1413 nt, Artificial Sequence
  neuraminidase__InfluenzaA__AGL96808
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacaguuuuuucucagugaaacaggauguuguagcaauaacugauuggucaggguacaguggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53965 - RNA, 1413 nt, Artificial Sequence
  neuraminidase__InfluenzaA__AGL96809
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaagaccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacaguggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53966 - RNA, 1413 nt, Artificial Sequence
  neuraminidase__InfluenzaA__AGL96818
augaacccaaaucaaaagauaauaaccauuggaucaaucaguauagcaaucggaauaaucagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaauuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53967 - RNA, 1413 nt, Artificial Sequence
  neuraminidase__InfluenzaA__AGL96820
augaacccaaaucaaaagauaauaaccacuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacaguggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53968 - RNA, 1413 nt, Artificial Sequence
  neuraminidase__InfluenzaA__AGL96821
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugucuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 53969 - RNA, 1410 nt, Artificial Sequence
  neuraminidase__InfluenzaA__AGN69269
augauuacaaaccaaagaauaauaaccaucgggacagucugucugauaguuggaauaguuagucuauuauugcagauaggaaauauagucucauuauggauaagccauucaauucagacuggagaaaaaaaucacucugagauaugcaaccaaaauaccauuacauaugaaaacaacacaugggugaaccaaacuuauguaaacauuagcaauaccaacauugcugauggacagggcgugacuucaauaauacuagccggcaauuccucucuuugcccaauaagugggugggcuauauacagcaaagacaauagcauaaggauugguuccaaaggagacauuuuugucauaagagaaccauucauuucaugcucucacuuggagugcagaaccuuuuuucugacccaaggugcuuugcuaaaugacaggcauucuaauggaaccgucaaggacaggagccccuaccgaaccuuaaugagcugcccgaucggugaagcuccaucuccguauaauucaagauucgaaucaguugcuuggucagcaagugcaugccaugauggaaugggauggauaacaaucgggauuuccgguccagauaauggagcaguggcuguuuugaaauacaaugguauaauaacagauacaauaaaaaguuggagaaacaaaauacuaagaacacaagagucagaauguguuuguauaaacgguucauguuuuacuauaaugacugauggcccaagcaaugggcaagccucguacaaaauauucaaaauggagaaagggaagauuauuaagucaguugagcuggaugcaccuaauuaccacuaugaggaaugcuccuguuacccugauacaggcaaaguggugugugugugcagagacaauuggcaugcuucaaaucgaccgugggucuccuucgaucagaaucuugauuaucagauaggguacauaugcagugggguuuucggugauaacccacguucuaaugaugggaaaggcaauuguggcccagcacuuucuaauggagcaaauggagugaaaggauucucauuuagauauggcaaugguguuuggauaggaagaacuaaaaguaucagcucuagaaguggauuugagaugauuugggauccaaauggauggacggaaacugauaguaguuucucuaugaagcaggauauuauagcauuaacugauuggucaggauauaguggaaguuuuguccaacauccugaauuaacaggaaugaacugcauaaggccuuguuuuuggguagaguuaaucagaggacaacccaaggagagcacaaucuggacuaguggaagcagcauuucuuucuguggcguggacagugaaaccgcaagcuggucauggccagacggagcugaucugccauucaccauugacaaguag

SEQ ID NO: 53970 - RNA, 1410 nt, Artificial Sequence
  neuraminidase__InfluenzaA__AGN69280
augaauacaaaccaaagaauaauaaccaucgggacagucugucugauaguuggaauaguuagucuauuauugcagauaggaaauauagucucauuauggauaagccauucaauucagacuggagaaaaaaaucacucugagauaugcaaccaaaauaccauuacauaugaaaacaacacaugggugaaccaaacuuauguaaacauuagcaauaccaacauugcugauggacagggcgugacuucaauaauacuagccggcaauuccucucuuugcccaauaagugggugggcuauauacagcaaagacaauagcauaaggauugguuccaaaggagacauuuuugucauaagagaaccauucauuucaugcucucacuuggagugcagaaccuuuuuucugacccaaggugcuuugcuaaaugacaggcauucuaauggaaccgucaaggacaggagccccuaccgaaccuuaaugagcugcccgaucggugaagcuccaucuccguauaauucaagauucgaaucaguugcuuggucagcaagugcaugccaugauggaaugggauggcuaacaaucgggauuuccgguccagauaauggagcaguggcuguuuugaaauacaaugguauaauaacagauacaauaaaaaguuggagaaacaaaauacuaagaacacaagagucagaauguguuuguauaaacgguucauguuuuacuauaaugacugauggcccaagcaaugggcaagccucguacaaaauauucaaaauggagaaagggaagauuauuaagucaguugagcuggaugcaccuaauuaccacuaugaggaaugcuccuguuacccugauacaggcaaaguggugugugugugcagagacaauuggcaugcuucaaaucgaccgugggucucuuucgaucagaaucuugauuaucagauaggguacauaugcagugggguuuucggugauaacccgcguucuaaugaugggaaaggcaauuguggcccaguacuuucuaauggagcaaauggagugaaaggauucucauuuagauauggcaaugguguuuggauaggaagaacuaaaaguaucagcucuagaaguggauuugagaugauuugggauccaaauggauggacggaaacugauaguaguuucucuaugaagcaggauauuauagcauuaacugauuggucaggauauaguggaaguuuuguccaacauccugaauuaacaggaaugaacugcauaaggccuuguuuuuggguagaguuaaucagaggacaacccaaggagagcacaaucuggacugguggaagcagcauuucuuucuguggcguggacagugaaaccgcaagcuggucauggccagacggagcugaucugccauucaccauugacaaguag

SEQ ID NO: 53971 - RNA, 1410 nt, Artificial Sequence
  neuraminidase__InfluenzaA__AGN69292
augaauccaaaucagaagauaauaaccauugguucgaucuguaugacaauuggaauagccagcuugauauuacaaauuggaaacauaauaucaauauggauuagccacucaauucaaacugagaaucagaaucagccugaaauaugcaaucaaaacgucauuacuuacgaaaacaacacuugggucaaccagacguauguuaacaucagcaacacuaauuuuguugcugaacaggcaguagcuucagugaaauuagcgggcaauuccucccucuguccuguuaguggaugggcuauauacaguaaagauaauaguguaagaaucgguuccaagggggauguguuugucauaagggagccauucauuucaugcucccacuuggaaugcagaacuuucuucuuaacucaaggggcccuuuugaaugacaaacacucuaacggaacaauuaaggacagaagcccauaucgaacauugaugagcuguccuauuggugaaguuccuucuccauacaacucaagauuugagucagucgcuuggucagcaagugccugccaugauggcacaaguuggcuaacaauuggaauuucuggcccagauaauggggcaguggcugugcugaaauacaauggcauaauaacagauacuaucaagaguuggagaaaaaacauauuaagaacacaagagucugaaugugcaugcguuaaugguucuugcuuuacaguaaugacugauggaccaaguaauggacaggccucguacaaggucuuuaagauagaaaaggggaaaguagucaaaucaguugaguugaaugccccuaauuaucacuaugaggaaugcuccuguuauccugaaucuggugaaaucacauguguguguagggauaauuggcauggcucaaauaggccgugggugucuuuuaaucagaaucuggaauaucaaaugggauacauaugcagugggauuuucggagauaauccacgcccuaaugauaaaacaggcaguugugguccaguauuuucuaauggggcaaaugggguaaaaggauuuucguuuaaauacggcaaugguguuuggauaggaagaacuaaaagcauuaguucaaggauggguuuugagaugauuugggauccggacggauggaccaaaacagacgauaaauucucaguaaagcaagauaucauaggaauaaaugauuggucaggauacaguggcaguuuuguucaacauccagaauugaccggacuggacuguaugaggccuugcuuuuggguugaacuaaucagagggcgacccaaagagaacacaaucuggacuagcgggaguagcauauccuuuugugguguaaauagugacacaguggguuggucuuggccagacggugcugaguugccauucaccauugacaaguaa

SEQ ID NO: 53972 - RNA, 1410 nt, Artificial Sequence
  neuraminidase__InfluenzaA__AGN69316
augaauccaaaucagaagauaauaaccauugguucgaucuguaugacaauuggaauagccagcuugauauuacaaauuggaaacauaauaucaauauggauuagccacucaauucaaacugagaaucagaaucagccugaaauaugcaaucaaaacgucauuacuuacgaaaacaacacuugggucaaccagacguauguuaacaucagcaauacuaauuuuguugcugaacaggcaguagcuucagugaaauuagcgggcaauuccucccucuguccuguuaguggaugggcuauauacaguaaagauaauaguguaagaaucgguuccaagggggauguguuugucauaagggagccauucauuucaugcucccacuuggaaugcagaacuuucuucuuaacucaaggggcccuuuugaaugacaaacacucuaacggaacaauuaaggacagaagcccauaucgaacauugaugagcuguccuauuggugagguuccuucuccauacaacucaagauuugagucagucgcuuggucagcaagugccugccaugauggcacaaguuggcuaacaauuggaauuucuggcccagauaauggggcaguggcugugcugaaauacaauggcauaauaacagauacuaucaagaguuggagaaaaaacauauuaagaacacaagaaucugaaugugcaugcguuaaugguucuugcuuuacaguaaugacugauggaccaaguaauggacaggccucguacaaggucuuuaagauagagaaggggaaaguagucaaaacaguugaguugaaugcuccuaauuaucacuaugaggaaugcuccuguuauccugaaucuggugaaaucacauguguguguagggauaauuggcauggcucaaauaggccgugggugucuuuuaaucagaaucuggaauaucaaaugggauacauaugcagugggauuuucggagauaauccacgcccuaaugauaaaacaggcaguugugguccaguauuuucuaauggggcaaaugggguaaaaggauuuucguuuaaauacggcaaugguguuuggauagggaggacuaaaagcauuaguucaaggauggguuuugagaugauuugggauccggacggauggaccaaaacagacgauaaauucucaguaaagcaagauaucauaggaauaaaugauuggucaggauacaguggcaguuuuguucaacauccagaauugaccggacuggacuguaugaggccuugcuuuuggguugaacuaaucagagggcgacccaaagagaacacaaucuggacuagcgggaguagcauauccuuuugugguguaaauagugacacaguggguuggucuuggccagacggugcugaguugccauucaccauugacaaguaa

SEQ ID NO: 53973 - RNA, 1410 nt, Artificial Sequence; identical to SEQ ID NO: 53972
  neuraminidase__InfluenzaA__AGN69328

SEQ ID NO: 53974 - RNA, 1410 nt, Artificial Sequence
  neuraminidase__InfluenzaA__AGN69340
augaauccaaaucagaagauaauaaccauugguuugaucuguaugacaauuggaauagccagcuugauauuacaaauuggaaacauaauaucaauauggauuagccacucaauucaaacugagaaucaaaauaagccugaaauaugcaaucaaaacgucauuacuuacgaaaacaacacuugggucaaccagacguauguuaacgucagcaacacuaauuuuguugcugaacaggcaguagcuucagugaaauuagugggcaauuccucucucuguccuguuaguggaugggcuauauacaguaaagauaauaguguacgaaucgguuccaagggggauguguuugucauaagggagccauucauuucaugcucccacuuggaaugcagaacuuucuucuuaacucaaggggcccuucugaaugacaaacauucuaauggaacaauuaaggacagaagcccauaucgaacauugaugagcuguccuauuggugagguuccuucuccauacaacucaagguuugagucagucgcuuggucagcaagugccugccaugauggcacaaguuggcuaacaauuggaauuucuggcccagauaauggggcaguggcugugcugaaauacaauggcauaauaacagacacuaucaagaguuggagaaagaacauauuaagaacacaagagucugaaugugcaugcguuaaugguucuugcuuuacaguaaugacugauggaccaaguaaugggcaggccucguacaaggucuuuaagauagaaagggggaaaguagucaaaucaguugaguugaaugccccuaauuaucacuaugaggaaugcuccuguuauccugaaucuagugaaaucacauguguguguagagauaauuggcauggcucaaaucggccgugggugucauuuaaucagaaucuggaauaucaaaugggauacauaugcagugggguuuucggagauaauccacgcccuaaugacaaaacaggcaguugugguccaguauuuucuaauggggcaaaugggguaaaaggauuuucauuuaaauacggcaaugguguuuggauagggagaacuaaaagcacuaguucaaggauggguuuugagaugauuugggauccggauggauggaccaaaacagaugauaaauucucaguaaagcaagauaucauaggaauaacugauuggucaggauacagugggaguuuuguucaacacccggaauugaccggacuggacuguaugaggccuugcuuuuggguugaacuaaucagagggcgacccaaagagaacacaaucuggacuagcgggaguagcauauccuuuugugguguaaauagugacacaguggguuggucuuggccagacggugcugaguugccauucaccauugacaaguaa

SEQ ID NO: 53975 - RNA, 1410 nt, Artificial Sequence
  neuraminidase__InfluenzaA__AGO00268
augaauccaaaucagaaaauaauaaccauuggaucaaucuguaugguagucggaauaauuagccuaauauugcaaauagggaauauuaucucaauauggauuagccauucaauucaaacuggaagucaaaaccauacuggaauaugcaaccaaagcaucauuaccuauaaaaauagcaccuggguaaaucaaacauauguuaauauuagcaacacaaacguuguugcuggaaaggacacaacuucaaugauauuagccggcaauucaucucuuuguccuauccgugggugggcuauauacagcaaagauaauggcauaagaauugguuccaaaggagauguuuuugucauaagagaaccuuuuauuucauguucucacuuggaaugcaggaccuuuuuucugacccaaggcgcccuguugaaugacaagcauucaaaugggaccguuaaggacagaagcccuuauagggccuuaaugagcugcccugucggugaagcuccguccccguacaauucaagguuugaaucgguugcuuggucagcaagugcaugucaugauggcaugggcuggcuaacaaucggaauuucugguccagaugauggagcaguggcuguguuaaaauacaacggcauaauaacugaaaccauaaaaaguuggaagaagaaaauauugagaacacaagagucugaaugugucuguguaaaugguucauguuuuacuauaaugacugacggcccgagugaugggccggccucguacaaaauuuucaagauugagaaggggaagguuacuaaaucaauagaguuggaugcaccuaauucucacuacgaggaauguuccuguuacccugauaccggcaaggugaugugugugugcagagacaauuggcacgguucgaaccgaccaugggugucuuucgaucaaaaccuggauuaucaaauaggauacaucugcagugggguuuucggugacaauccgcgucccaaagauggaaaaggcagcugugguccaguguauguugauggagcaaacggaguaaagggauuuucauacagguauggugaugguguuuggauaggaaggacuaaaaguaacaguuccagacagggguuugagaugauuugggauccuaauggguggacagagacugauaguaguuucuuugugaaacaagauguaguggcaaugacugauuggucaggguacagcggaaguuucguucagcauccugagcuaacagggcugaacuguaugaggccuugcuucuggguugaauuaaucaggggacgaccuaaagaaaaaacaaucuggacuagugggagcagcaucucuuuuuguggcgugaauagugauacuguagauuggucuuggccagacggcgccgagcugccauucaccaucgacaaguag

SEQ ID NO: 53976 - RNA, 1410 nt, Artificial Sequence
  neuraminidase__InfluenzaA__AGO00280
augaauccaaaucagaaaauaauaaccauuggaucaaucuguaugguagucggaauaauuagccuaauauugcaaauagggaauauugucucaauauggauuagccauucaauucaaacuggaaaucaaaaccauacuggaacuugcaaccaaagcaucauuaccuauaaaaauagcaccuggguaaaucagacauaugucaauauuagcaacacuaacguuguugcugggaaggauacaacuucagugauauuagccggcaauucaucucuuugcccuauccgugggugggcuauauacagcaaagauaauggcguaagaauugguuccaaaggagauguuuuugucauaagagaacccuuuauuucauguucucacuuggaaugcaggaccuuuuuucugacccaaggcgcccuguugaaugacaagcauucaaaugggaccguuaaggacagaagcccuuauagggccuuaaugagcugcccuguuggugaagcuccguccccguacaauucaagguuugaaucgguugcuuggucagcaagugcaugucaugauggcaugggcuggcuaacaaucggaauuucugguccagaugauggagcaguggcuguguuaaaauacaacggcauaauaacugaaaccauaaaaaguuggaggaaggaaauauugagaacacaagagucugaaugugucugcguaaaugguucauguuucacuauaaugaccgacggcccgaguggugggccggccucguacaaaauuuucaagaucgagaaggggaagguuacuaaaucaauagaguuggaugcaccuaauucucacuacgaggaauguuccugcuacccugauaccagcaaggugaugugugugugcagagacaauuggcacgguucgaaccgaccaugggugucuuucgaucaaaaucuggauuaucaaaugggauacaucugcagugggguuuucggugacaauccgcgucccaaagauggaaaaggcagcugugguccaguguauguugauggagcaaacggaguaaagggauuuucauacagguaugguaaugguguuuggauaggaaggacuaaaaguaacaguuccagacagggguuugagaugauuugggauccuaauggguggacagagacugauaguaauuucuuuaugaaacaagauguaguggcaguaaccgauuggucaggguacagcggaaguuucguucaacauccugagcuaacagggcuggacuguaugaggccuugcuucuggguugaauuaaucaggggacgaccuaaagaaaauacaaucuggaccagugggagcagcauuucuuuuuguggugugaauagugauacuguagauuggucuuggccagacggugccgaguugccauucaccauugacaaguag

SEQ ID NO: 53977 - RNA, 1413 nt, Artificial Sequence
  neuraminidase__InfluenzaA__AGO00292
augaauccaaaucagaaaauaauaaccauuggaucaaucuguaugacaaucggaacaauuagucuaauauugcaaauagggaauauuaucucaauauggauuagccacucaauucaaacuggaagucaaaaccauacuggaauaugcaaccaaagaaucauuaccuaugaaaauaacaccuggguaaaucaaacauauguuaauauuagcaacaccaacguuguugcuggaaaggacacaacuucaaugauauuagccggcaauucaucucuuuguccuauccgugggugggcuauauacagcaaagacaacagcauaaggauugguuccaaaggagauguuuuugucauaagagaaccuuuuauaucaugcucucacuuggaaugcagaaccuuuuuucugacccaaggcgcucuauuaaaugacaagcauucaaacgggaccguuaaagacagaagcccuuauagggccuuaaugagcuguccuaucggugaagcuccgucuccguacaauucaagauuugaaucgguugcuuggucagcgagugcaugucaugauggcaugggcuggcuaacuaucggaauuucugguccagaugauggagcaguggcuguauuaaaauacaauggcauaauaacugaaaucauaaaaaguuggaggaagcaaauauuaagaacacaagagucugaaugugucuguguaaacgguucauguuuuaccauaaugaccgauggcccgagugaugggccggccucguacagaaucuucaaaaucgaaaaggggaagauuacuaaaucaauagaguuggaugcaccuaauucucauuacgaggaauguuccuguuacccagacaccggcaaagugaugugugugugcagagacaauuggcaugguucgaaucgaccaugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguauggugaugguguuuggauaggaaggacuaaaaguaacaguuccagaaagggguuugagaugauuugggauccuaauggguggacagauaccgaugauaauuucuuagugaaacaggauguaguggcaaugacugauuggucaggguauagcggaaguuucguucaacauccugagcuaacaggauuggacuguauaaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucacaauugacauguag

SEQ ID NO: 53978 - RNA, 1413 nt, Artificial Sequence
  neuraminidase__InfluenzaA__AGO00304
augaacccaaaucagaaaauaauaaccauuggaucaaucuguauggcaaucggaacaaucagucuaauacugcaaauagggaauauuaucucaauauggauuagccacucaauucaaacuggaagucaaaaccauacuggaauaugcaaccaaagaaucauuaccuaugaaaauaauaccuggguaaaucaaaccuauguuaauauuagcaacacuaacguuguugcuggaaaggacacaacuucaaugauauuagccggcaauacaucucuuuguccuauccgugggugggcuauauacagcaaggacaacaguauaagaauugguuccaaaggagauguuuuugucauaagagaaccuuuuauaucaugcucucacuuggaaugcagaaccuuuuuucugacccaaggcgcucuguuaaaugacaagcauucaaaugggaccguuaaggacagaagcccuuauagggccuuaaugagcuguccuaucggugaagcuccgucuccguacaauucaagauuugaaucgguugcuuggucagcgagugcaugucaugauggcaugggcuggcuaacaaucggaauuucugguccagaugauggagcaguggcuguauuaaaauacaacggcauaauaacugaaaucauaaaaaguuggaggaaacaaauauuaagaacacaagagucugaaugugucuguguaaacgguucauguuuuaccauaaugaccgaugguccgaguaaugggccggccucguacagaaucuucaaaaucgagaaggggaagauuacuaaaucaauagaguuggaugcaccuaauucucauuacgaggaauguuccuguuacccagacaccggcaaagugaugugugugugcagagacaauuggcaugguucgaaucgaccgugggugucuuuuaaccaaaaccuggauuaucaaauaggauacaucugcagugggguuuucggugacaauccgcgucccaaagauggaaagggcagcugugauccaguaaauguugauggagcagacggaguaaagggguuuucauacagguaugguaaugguguuuggauaggaaggacuaaaaguaacaguuccagaaaaggguuugagaugauuugggauccuaauggguggacaaauaccgaugguaauuucucagugaaacaggaugugguggcaaugacugauuggucaggguauaguggaaguuucguucaacauccugagcuaacaggauuggacuguaugagaccuugcuucuggguugaauuaaucagaggacgacccagagaaaaaacaacuaucuggacuagugggagcagcauuucuuuuuguggcgugaauagugauacuguaaauuggucuuggccagacggugccgaguugccauucaccauugacaaguag

SEQ ID NO: 53979 - RNA, 1410 nt, Artificial Sequence; identical to SEQ ID NO: 53048
  neuraminidase__InfluenzaA__AGO00316

SEQ ID NO: 53980 - RNA, 1410 nt, Artificial Sequence; identical to SEQ ID NO: 52492
  neuraminidase__InfluenzaA__AGO00328

SEQ ID NO: 53981 - RNA, 1410 nt, Artificial Sequence; identical to SEQ ID NO: 44599
  neuraminidase__InfluenzaA__AGO00340

SEQ ID NO: 53982 - RNA, 1365 nt, Artificial Sequence; identical to SEQ ID NO: 46223
  neuraminidase__InfluenzaA__AGO00352

SEQ ID NO: 53983 - RNA, 1365 nt, Artificial Sequence; identical to SEQ ID NO: 47198
  neuraminidase__InfluenzaA__AGO00376

SEQ ID NO: 53984 - RNA, 1365 nt, Artificial Sequence; identical to SEQ ID NO: 47198
  neuraminidase__InfluenzaA__AGO00388

SEQ ID NO: 53985 - RNA, 1365 nt, Artificial Sequence; identical to SEQ ID NO: 47198
  neuraminidase__InfluenzaA__AGO00400

SEQ ID NO: 53986 - RNA, 1365 nt, Artificial Sequence; identical to SEQ ID NO: 47198
  neuraminidase__InfluenzaA__AGO00412

SEQ ID NO: 53987 - RNA, 1365 nt, Artificial Sequence; identical to SEQ ID NO: 47198
  neuraminidase__InfluenzaA__AGO00424

SEQ ID NO: 53988 - RNA, 1365 nt, Artificial Sequence
  neuraminidase__InfluenzaA__AGO00436
augaauccaaaucagaaaauaauaaccauuggaucaaucugucugguagucggacuaauuagccuaauauugcaaauagggaauauaaucucaauauggauuagccauucaauucaaacuggaagucaaaaccauacuggaauaugcaaccaaaacaucauuaccuauaaaaauagcaccuggguaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaagcauucaagugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucaauagaguugaaugcaccuaauucuaacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccgaagauggaacaggcagcugugguccaguguauguugauggagcaaacggaguaaagggauuuucauauagguaugguaaugguguuuggauaggaaggaccaaaagucacaguuccagacauggguuugagaugauuugggauccuaauggauggacagagacugauaguaaguucucugugaggcaagauguuguggcaaugacugauuggucaggguauagcggaaguuucguucaacauccugagcugacagggcuagacuguaugaggccgugcuucuggguugaauuaaucaggggacgaccuaaagaaaaaacaaucuggacuagugcgagcagcauuucuuuuuguggcgugaauagugauacuguagauuggucuuggccagacggugcugaguugccauucagcauugacaaguag

SEQ ID NO: 53989 - RNA, 1365 nt, Artificial Sequence
  neuraminidase__InfluenzaA__AGO00448
augaauccaaaucagaaaauaauaaccauuggaucaaucugucugguagucggacuaauuagccuaauauugcaaauagggaauauaaucucaauauggauuagccauucaauucaaacuggaagucaaaaccauacuggaauaugcaaccaaaacaucauuaccuauaaaaauagcaccuggguaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaagcauucaagugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacagaauuuucaagaucgaaaaggggaagguuacuaaaucaauagaguugaaugcaccuaauucucacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccgaagauggaacaggcagcugugguccaguguauguugauggagcaaacggaguaaagggauuuucauauagguaugguaaugguguuuggauaggaaggaccaaaagucacaguuccagacauggguuugagaugauuugggauccuaauggauggacagagacugauaguaaguucucugugaggcaagauguuguggcaaugacugauuggucaggguauagcggaaguuucguucaacauccugagcugacagggcuagacuguaugaggccgugcuucuggguugaauuaaucaggggacgaccuaaagaaaaaacaaucuggacuagugcgagcagcauuucuuuuuguggcgugaauagugauacuguagauuggucuuggccagacggugcugaguugccauucagcauugacaaguag

SEQ ID NO: 53990 - RNA, 1410 nt, Artificial Sequence
  neuraminidase__InfluenzaA__AGQ47722
augaauacaaaucaaagaauaauaaccauugggacaaucugucuaauaguuggaauaauuagucuauuauugcagauagggaauauaaucucguuauggauaagccauucaauucagacuggagaaaaaagccauccugagauaugcaaccaaagugucauuaccuaugaaaacaacacaugggugaaccaaacuuauguaaacauuagcaauaccaauauugcugcuggacaaggugugacuccaauaauacuagccggcaauuccucucuuugcccaaucagugggugggcuauauacagcaaagacaauagcauaaggauugguuccaaaggggacauuuuugucaugagagagccauucauuucaugcucucacuuggaaugcagaaccuuuuuucugacccaaggcgcuuugcugaaugacaggcauucuaauggaaccgucaaggacaggaguccuuauagaaccuuaaugagcugccccauuggugaagcuccaucuccguacaauucaagguucgaaucaguugcuuggucagcaagugcaugccaugauggaaugggauggcuaacaaucgggauuuccgguccagauaauggagcaguggcuguuuuaaaauacaaugguauaauaacagauacaauaaaaaguuggagaaacaaaauauuaagaacacaagagucugaauguguuuguauaaacgguucguguuuuacuauaaugacugacggcccaagcaaugggcaagccucguacaaaauauucaaaauggagaaagggaagauuauuaagucaauugagcuagaugcaccuaauuaccacuaugaggaaugcuccuguuacccugauacaggcaaagugaugugugugugcagagacaauuggcaugcuucgaaucgaccaugggucucuuucgaucagaaucuugauuaucaaauaggguacauaugcagugggguuuucggugauaauccgcguuccaaugaugggaaaggcaauuguggcccaguacuuucuaauggagcaaauggaguaaagggguuuucauuuagauauggcaaugguguuuggauaggaagaacuaaaaguaucagcucuagaaguggauuugagaugguuugggauccuaauggauggacagaaacugauaguaguuucucuaugaagcaagauauuauagcauuaacugauuggucgggauacaguggaaguuuuguccaacauccugaauuaacaggaaugaacugcauaaggccuuguuucuggguugaguuaaucagagggcaacccaaggagagcacaaucuggacuaguggaagcagcauuucuuucuguggcgugaacaguggcacugcaagcuggucauggccagacggagcugaucugccauucaccauugacaaguag

SEQ ID NO: 53991 - RNA, 1413 nt, Artificial Sequence; identical to SEQ ID NO: 46957
  neuraminidase__InfluenzaA__AGQ47731

SEQ ID NO: 53992 - RNA, 1377 nt, Artificial Sequence
  neuraminidase__InfluenzaA__AGQ47743
augaauccaaaccagaaaauaauaaccauugggucaaucuguaugguagucggaauaauuagccuaauauugcaaauagggaauauaaucucaauauggauuagccauucaauucaaaccggaaaucaaaaccauaaaaauagcaccuggaugaaucaaacauauauuaauauuagcaacacuaacguuguugcugggcaggacucaacuucagugauauuaaccggcaauucaucucuuugucccauccgugggugggcuauaaacagcaaagacaauggcauaagaauugguuccaaaggagacguuuuugucauaagagagccuuuuauuucauguucucacuuggaaugcaggaccuuuuuucugacucaaggcgccuuacugaaugacaagcauucaaaugggaccguuaaggacagaagcccuuauagggccuuaaugagcugcccugucggugaagcuccguccccguacaauucaagguuugaaucgguugcuuggucagcaagugcaugucaugauggcaugggcuggcuaacaaucggaauuucugguccagauaauggagcaguggcuguauuaaaauacaacggcauaauaacugaaaccauaaaaaguuggaggaagaaaauauugagaacacaagagucugaauguaccuguguaaaugguucauguuuuaccauaaugaccgauggcccaaguaaugggcuggccucguacaaaauuuucaagaucgagaaggggaagguuacuaaaucaauagaguugaaugcaccuaauucucacuacgaggaauguuccuguuacccugauaccggcaaagugaugugugugugcagagacaauuggcacgguucgaaccgaccaugggugucuuucgaucaaaaccuagauuaucaaauaggauacaucugcagugggguuuucggugacaacccgcgucccaaagauggaacaggcaguuguggcccagugucugcugauggagcaaacggaguaaagggauuuucauauagguaugguaaugguguuuggauaggaaggacuaaaaguaacaguuccagacauggguuugagaugauuugggauccuaauggauggacagagacugauaguagguucucugugagacaagauguuguggcaaugacugaucggucaggguacagcggaaguuucguucaacauccugagcuaacagggcuagacuguaugaggccuugcuucuggguugaauuaaucaggggacgaccugaggaggaaacaaucuggacuagugggagcaucauuucuuuuuguggcgugaauagugauacuguagauuggucuuggccagacggugcugaguugccguucaccauugacaaguag

SEQ ID NO: 53993 - RNA, 1413 nt, Artificial Sequence
  neuraminidase__InfluenzaA__AGQ47755
augaacccaaaucagaaaauaauaaccauuggaucaaucuguauggcaaucggaacaaucagucuaauacugcaaauagggaauauuaucucaauauggauuagccacucaauucaaacuggaagucaaaaccauacuggaauaugcaaccgaagaaucguuaccuaugaaaauaauaccuggguaaaucaaacauauguuaauauuagcaacacuaacguuguugcugaaaaggacacaacuucaaugauauuagccggcaauucaucucuuuguccuauccgugggugggcuauauacagcaaggacaacagcauaagaauugguuccaaaggagauguuuuugucauaagagaaccuuuuauaucaugcucucacuuggaaugcagaaccuuuuuucugacccaaggcgcucuauuaaaugacaagcauucaaaugggaccguuaaggacagaagcccuuauagggccuuaaugagcuguccuaucggugaagcuccgucuccguacaauucaagauuugaaucgguugcuuggucagcgagugcaugucaugauggcaugggcuggcuaacaaucggaauuucugguccagaugauggagcaguggcuguauuaaaauacaacggcauaauaacugaaaucauaaaaaguuggaggaagcaaauauuaagaacacaagagucugaaugugucuguguaaacgguucauguuuuaccauaaugaccgaugguccgaguaaugggccggccucguacagaaucuucaaaaucaagaaggggaagauuacuaaaucaauagaguuggaugcaccuaauucucauuacgaggaauguuccuguuacccagacaccggcaaagugaugugugugugcagagacaauuggcaugguucgaaucgaccaugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaccaguuccagaaagggguuugagaugauuugggauccuaauggguggacagauaccgaugguaauuucuuagugaaacaggauguaguggcaaugacugauuggucaggguauagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 53994 - RNA, 1410 nt, Artificial Sequence
  neuraminidase__InfluenzaA__AGQ47767
augaauccaaaucagaaaauaauaaccauuggaucaaucuguaugguagucggaauaauuagccuaauauugcaaauagggaauauugucucaauauggauuagccauucaauucaaacuggaaaucaaaaccauacuggaacuugcgaccaaagcaucauuaccuauaaaaauagcaccuggguaaaucaaacauaugucaauauuagcaacacuaacguuguugcugggaaggauacaacuucagugauauuagccggcaauucaucucuuugcccuauccgugggugggcuauauacagcaaagauaauggcguaagaauugguuccaaaggagauguuuuugucauaagagaacccuuuauuucauguucucacuuggaaugcaggaccuuuuuucugacccaaggcgcccuguugaaugacaagcauucaaaugggaccguuaaggacagaagcccuuauagggccuuaaugagcugcccuguuggugaagcuccguccccguacaacucaagguuugaaucgguugcuuggucagcaagugcaugucaugauggcaugggcuggcuaacaaucggaauuucugguccagaugauggagcaguggcuguguuaaaauacaacggcauaauaacugaaaccauaaaaaguuggaggaaggaaauauugagaacacaagagucugaaugugucugcguaaaugguucauguuucacuauaaugaccgacggcccgaguggugggccggccucguacaaaauuuucaagaucgagaaggggaagguuacuaaaucaauagaguuggaugcaccuaauucucacuacgaggaauguuccuguuacccugauaccagcaaagugaugugugugugcagagacaauuggcacgguucgaaccgaccaugggugucuuucgaucaaaaucuggauuaucaaaugggauacaucugcagugggguuuucggugacaauccgcgucccaaagauggaaaaggcagcugugguccaguguauguugauggagcaaacggaguaaagggauuuucauacaaguaugguaaugguguuuggauagggaggacuaaaaguaacaguuccagacagggguucgagaugauuugggauccuaauggguggacagagacugauaguaauuucuuuacgaaacaagauguaguggcaguaaccgauuggucaggguacagcggaaguuucguucaacauccugagcuaacagggcuggacuguaugaggccuugcuucuggguugaauuaaucaggggacgaccuaaagaaaauacaaucuggaccagugggagcagcauuucuuuuuguggugugaauagugauacuguagauuggucuuggccagacggugccgaguugccauucaccauugacaaguag

SEQ ID NO: 53995 - RNA, 1410 nt, Artificial Sequence
  neuraminidase__InfluenzaA__AGQ47779
augaauccaaaucagaaaauaauaaccauuggaucaaucuguaugguagucggaauaauuagccuaauauugcaaauagggaauauugucucaauauggauuagccauucaauucaaacuggaaaucaaaaccauacuggaacuugcaaccaaagcaucauuaccuauaaaaauagcaccuggguaaaucagacauaugucaauauuagcaacacuaacguuguugcugggaaggauacaacuucagugauauuagccggcaauucaucucuuugcccuauccgugggugggcuauauacagcaaagauaauggcguaagaauuggcuccaaaggagauguuuuugucauaagagaacccuuuauuucauguucucacuuggaaugcaggaccuuuuuucugacccaaggcgcccuguugaaugacaagcauucaaaugggaccguuaaggacagaagcccuuauagggccuuaaugagcugcccuguuggugaagcuccguccccguacaauucaagguuugaaucgguugcuuggucagcaagugcaugucaugauggcaugggcuggcuaacaaucggaauuucugguccagaugauggagcaguggcuguguuaaaauacaacggcauaauaacugaaaccauaaaaaguuggaggaaggaaauauugagaacacaagagucugaaugugucugcguaaaugguucauguuucacuauaaugaccgacggcccgaguggugggccggccucguacaaaauuuucaagaucgagaaggggaagguuacuaaaucaauagaguuggaugcaccuaauucucacuacgaggaauguuccuguuacccugauaccagcaaggugaugugugugugcagagacaauuggcacgguucgaaccgaccaugggugucuuucgaucaaaaucuggauuaucaaaugggauacaucugcagugggguuuucggugacaauccgcgucccaaagauggaaaaggcagcugugguccaguguauguugauggagcaaacggaguaaagggauuuucauacagguaugguaaugguguuuggauaggaaggacuaaaaguaacaguuccagacagggguuugagaugauuugggauccuaauggguggacagagacugauaguaauuucuuuaugaaacaagauguaguggcaguaaccgauuggucaggguacagcggaaguuucguucaacauccugagcuaacagggcuggacuguaugaggccuugcuucuggguugaauuaaucaggggacgaccuaaagaaaauacaaucuggaccagugggagcagcauuucuuuuuguggugugaauagugauacuguagauuggucuuggccagacggugccgaguugccauucaccauugacaaguag

SEQ ID NO: 53996 - RNA, 1413 nt, Artificial Sequence
  neuraminidase__InfluenzaA__AGQ47791
augaauccaaaucagaaaauaauaaccauuggaucaaucuguauggcaaucggaauaauuagucuaauauugcaaauagggaauauuaucucaauauggguuagccacucaauucaaacuggaagucaaaaccauacuggaauaugcaaccaaagaaucauuaccuaugaaaauaacaccuggguaaaucaaacacauguuaauauuagcaacacuaacguuguugcuggaaaggacacaacuucaaugauauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccguacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaagaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcaccuaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggguuugagaugauuugggauccuaauggguggacagauaccgaugguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 53997 - RNA, 1410 nt, Artificial Sequence
  neuraminidase__InfluenzaA__AGQ47803
augaauccaaaucagaaaauaauaaccauuggaucaaucuguaugguagucggaauaauuagccuaauauugcaaauagggaauauuaucucaauauggauuagccauucaauucaaacuggaagucaaaaccauacuggaauaugcaaccaaagcaucauuaccuauaaaaauagcaccuggguaaaucaaacauauguuaauauuagcaacacuaacguuguugcuggaaaaggcacaacuucagugauauuagccggcaauucaucucuuuguccuauccgugggugggcuauauacagcaaagauaacggcauaagaauugguuccaaaggagauguuuuugucauaagagagccuuuuauuucauguucucacuuggaaugcaggacuuuuuuucugacccaaggcgcccuguugaaugacaagcauucaaaugggaccguuaaggacagaagcccuuauagggccuugaugagcugcccugucggugaagcuccguccccguacaauucaagguuugaaucgguugcuuggucagcaugugcaugucaugauggcaugggcuggcuaacaaucggaauuucugguccagaugaugaagcaguggcuguguuaaaauacaacggcauaauaacugaaaccauaaaaaguuggaggaagaaaauauugagaacacaagagucugaaugugucuguguaaaugguucauguuuuacuauaaugaccgacggcccgagugaugggccggccucguacaaaauuuucaagaucgagaaggggaagguuacuaaaucaauagaguuggaugcaccuaauucucacuacgaggaauguuccuguuacccugauaccggcaaggugaugugugugugcagagacaauuggcacgguucgaaccgaccaugggugucuuucgaucaaaaucuggauuaucaaauaggauacaucugcagugggguuuucggugacaauccgcgucccaaagauggaaaaggcagcugugguccgguguauguugauggagcaaacggaguaaagggauuuucauacagguaugguaaugguguuuggauaggaaggacuaaaagugacaguuccagacagggguuugagaugauuugggauccuaauggguggacagagacugauaguaauuucuuugugaaacaagauauaguggcuaugacugauuggucaggguacagcggaaguuucguucaacauccugagcuaacagggcuggacuguaugaggccuugcuucuggguugaauuaaucaggggacgaccuaaagaaaaaacaaucuggacuagugggagcagcauuucuuuuuguggcgugaauagugauacuguagacuggucuuggccagacggugccgaauugccauucaccauugacaaguag

SEQ ID NO: 53998 - RNA, 1368 nt, Artificial Sequence
  neuraminidase__InfluenzaA__AGQ47814
augaauccaaaucagaaaauaauaaccauuggaucaaucuguauggcaaucggaauaauuagucuaauauugcaaauagggaauauuaucucaauauggguuagccacucaauucaaacuggaagucaaaaccauacuggaauaugcaaccaaagaaucauuaccuaugaaaauaacaccuggguaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacucaaggcgcucuauuaaaugacaagcauucaaaugggaccguuaaggacagaagcccuuauagggccuuaaugagcuguccuauaggugaagcuccgucuccguacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaagaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcaccuaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggguuugagaugauuugggauccuaauggguggacagauaccgaugguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 53999 - RNA, 1413 nt, Artificial Sequence; identical to SEQ ID NO: 46961
  neuraminidase__InfluenzaA__AGQ47826

SEQ ID NO: 54000 - RNA, 1410 nt, Artificial Sequence
  neuraminidase__InfluenzaA__AGQ47838
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuagugggauacaggaauuggucaaagccgcaauguaaaauuacaggauuugcaccuuuuucuaaggacaauucaauucggcuuucugcugguggggauauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaagcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauucucaggacccaggagucggaaugcguuuguaucaaugggacuuguacaguaguaaugacugauggaagugcuucagggagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaguagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 54001 - RNA, 1362 nt, Artificial Sequence
  neuraminidase__InfluenzaA__AGQ47850
augaauccaaaucagaaaauaauaaccauugggucaaucuguaugguagucggaauaauuagccuaauauugcaaauagggaauauaaucucaauauggauuagccauucaauucaagcugggaguagcaccugggugaaucaaacauauguuaauauuagcaacacuaacguugucgcuggaccggacgcaacuucagugauauuaaccggcaauucaucucuuugucccauccgugggugggcuauauacagcaaagacaauggcauaagaauugguuccaaaggagacauuuuugucauaagagagccuuuuauuucauguucucacuuggaaugcagggccuuuuuucugacucaaggcgccuuacugaaugacaagcauucaaaugggaccguuaaggacagaagcccuuauagggccuuaaugagcugcccugucggugaagcuccguccccguacaauucaagguuugaaucgguugcuuggucagcaagugcaugucaugauggcaugggcuggcuaacaaucggaauuucugguccagauaauggggcaguggcuguauuaaaauacaacggcauaauaacugaaaccauaaaaaguuggaggaagaaaauauugagaacacaagagucugaaugugccuguguaaaugguucauguuuuacuauaaugaccgauggcccaagugaugggccggccucguacaaaauuuucaagaucgagaaggggaagguuacuaaaucaauagaguuggaugcaccuaacucucacuacgaggaguguuccuguuacccugauaccggcaaagugaugugugugugcagagacaauuggcacgguucgaaccgaccaugggugucuuucgaucaaaaccuggauuaucaaauaggauacaucugcagugggguuuucggugacaguccgcgucccaaagauggaacaggcagcugugguccagugucuguugauggagcaaacggagugaagggauuuucauauagguaugguaaugguguuuggauaggaaggacuaaaaguaaaaguuccagacauggguuugagaugauuugggauccuaauggauggacagaaacugauaguagguucucugugagacaagauguuguggcaaugacugauuggucaggguacagcggaaguuucguucaacauccugagcuaacagggcuagacuguaugaggccuugcuucuggguugaauuaaucagggggcaaccuaaagagaaaacaaucuggacuagugggagcagcauuucuuuuuguggcgugaauagugauacuguagacuggucuuggccagacggugcugaguugccauucaccauugacaaguag

SEQ ID NO: 54002 - RNA, 1410 nt, Artificial Sequence
  neuraminidase__InfluenzaA__AGQ47873
augaauacaaaucaaagaacaauaaccauugggacaaucugucuaauaguuggaauaauuagucuauuauugcagauaggaaauauaaucuuguuauggaugagccauucaauucagacuggagaaaaaagccauccuaagguaugcaaccaaagugucauuaccuaugaaaacaacacaugggugaaccagacuuauguaaacauuagcaauaccaauauugcugcuggacagggugugacuccaauaauacuagccggcaauuccucucuuugcccaaucagugggugggcuauauacagcaaagacaauagcauaaggauugguuccaaaggagacauuuuugucaugagagagccauucauuucaugcucucacuuggaaugcagaaccuuuuuucugacccaaggcgcuuugcugaaugacaggcauucuaauggaaccgucaaggacaggaguccuuauagaaccuuaaugagcugccccaucggugaagcuccaucuccguacaauucaagguucgaaucaguugcuuggucagcaagugcaugccaugauggaaugggauggcuaacaaucgggauuuccgguccagauaauggagcaguggcuguuuuaaaauacaaugguauaauaacagauacaauaaaaaguuggagaaacaaaauauuaagaacacaagagucugaauguguuuguauaaacgguucguguuuuacuauaaugacugacggcccaagcaaugggcaagccucguacaaauuauucaaaauggagaaagggaagauuauuaagucaauugagcuggaugcaccuaauuaccacuaugaggaaugcuccuguuacccugauacaggcaaaguggugugugugugcagagacaauuggcaugcuucgaaucgaccaugggucucuuucgaucagaaucuugauuaucaaauaggguacauaugcagugggguuuucggugauaauccgcguucuaaugaugggaaaggcaauuguggcccaguacuuucuaauggagcaaauggagugaagggguuuucauuuagauauggcaaugguguuuggauaggaagaacuaaaaguaucagcucuagaaguggauuugagaugauuugggauccuaauggauggacagaaacugauaguaguuucucuaugaagcaagauauuauagcauuaacugauuggucgggauacaguggaaguuuuguccaacauccugaauuaacaggaaugaacugcauaaggccuuguuucuggguagaguuaaucagagggcaacccaaggagagcacaaucuggacuaguggaagcagcauuucuuucuguggcgugaacaguggcacugcaagcuggucauggccagacggagcugaucugccauucaccauugacaaguag

SEQ ID NO: 54003 - RNA, 1410 nt, Artificial Sequence; identical to SEQ ID NO: 47718
  neuraminidase__InfluenzaA__AGQ47885

SEQ ID NO: 54004 - RNA, 1410 nt, Artificial Sequence; identical to SEQ ID NO: 52484
  neuraminidase__InfluenzaA__AGQ47897

SEQ ID NO: 54005 - RNA, 1410 nt, Artificial Sequence; identical to SEQ ID NO: 44611
  neuraminidase__InfluenzaA__AGQ47909

SEQ ID NO: 54006 - RNA, 1410 nt, Artificial Sequence
  neuraminidase__InfluenzaA__AGQ47921
augaauccaaaucaaaagauaauaacaauuggcucugucucucucaccauugcaacaguaugcuuccucaugcagacugccauccugguaaccacuguaacauugcauuuuaagcaauaugagugcgacuccccugcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauaccagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggaggcuagagugugguggaccucaaacaguauuguuguguuuuguggcacuucagguaccuauggaacaggcucauggccugauggggcgaacaucaauuucaugccuauauaa

SEQ ID NO: 54007 - RNA, 1365 nt, Artificial Sequence
  neuraminidase__InfluenzaA__AGQ47933
augaauccaaaucagaaaauaauaaccauuggaucaaucuguaugguagucggacuaauuagccuaauauugcaaauagggaauauaaucucaauauggauuagccauucaauucaaacuggaagucaaaaccauacuggaauaugcaaccaaaacaucauuaccuauaaaaauagcaccuggguaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaggcauucaaaugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucaauagaguugaaugcaccuaauucucacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccaaagauggaacaggcagcugugguccaguguauguugauggagcaaacggaguaaagggauuuucauauagguaugguaaugguguuuggauaggaagaaccaaaagucacaguuccagacauggguuugagaugauuugggauccuaauggauggacagagacugauaguaaguucucugugaggcaagauguuguggcaaugacugauuggucaggguauagcggaaguuucguucaacauccugagcuaacagggcuagacuguauaaggccgugcuucuggguugaauuaaucaggggacgaccuaaagaaaaaacaaucuggacuagugcgagcagcauuucuuuuuguggcgugaauagugauacuguaaauuggucuuggccagacggugcugaguugccauucaccauugacaaguag

SEQ ID NO: 54008 - RNA, 1365 nt, Artificial Sequence; identical to SEQ ID NO: 46223
  neuraminidase__InfluenzaA__AGQ47945

SEQ ID NO: 54009 - RNA, 1365 nt, Artificial Sequence; identical to SEQ ID NO: 46223
  neuraminidase__InfluenzaA__AGQ47957

SEQ ID NO: 54010 - RNA, 1365 nt, Artificial Sequence; identical to SEQ ID NO: 47198
  neuraminidase__InfluenzaA__AGQ47969

SEQ ID NO: 54011 - RNA, 1365 nt, Artificial Sequence; identical to SEQ ID NO: 47198
  neuraminidase__InfluenzaA__AGQ47981

SEQ ID NO: 54012 - RNA, 1365 nt, Artificial Sequence
  neuraminidase__InfluenzaA__AGQ48005
augaauccaaaucagaaaauaauaaccauuggaucaaucugucugguagucggacuaauuagccuaauauuacaaauagggaauauaaucucaauauggauuagccauucaauucaaacuggaagucaaaaccauacuggaauaugcaaccaaaacaucauuaccuauaaaaauagcaccuggguaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaagcauucaagugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucaauagaguugaaugcaccuaauucucacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccgaagauggaacaggcagcugugguccaguguauguugauggagcaaacggaguaaagggauuuucauauagguauaguaaugguguuuggauaggaaggaccaaaagucacaguuccagacauggguuugagaugauuugggauccuaauggauggacagagacugauaguaaguucucugugaggcaagauguuguggcaaugacugauuggucaggguauagcggaaguuucguucaacauccugagcugacagggcuagacuguaugaggccgugcuucuggguugaauuaaucaggggacgaccuaaagaaaaaacaaucuggacuagugcgagcagcauuucuuuuuguggcgugaauagugauacuguagauuggucuuggccagacggugcugaguugccauucagcauugacaaguag

SEQ ID NO: 54013 - RNA, 1365 nt, Artificial Sequence; identical to SEQ ID NO: 54012
  neuraminidase__InfluenzaA__AGQ48017

SEQ ID NO: 54014 - RNA, 1365 nt, Artificial Sequence; identical to SEQ ID NO: 47198
  neuraminidase__InfluenzaA__AGQ48029

SEQ ID NO: 54015 - RNA, 1365 nt, Artificial Sequence
  neuraminidase__InfluenzaA__AGQ48041
augaauccaaaucagaaaauaauaaccauuggaucaaucugucugguagucggacuaauuagccuaauauuacaaauagggaauauaaucucaauauggauuagccauucaauucaaacuggaagucaaaaccauacuggaauaugcaaccaaaacaucauuaccuauaaaaauagcaccuggauaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaagcauucaagugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucaauagaguugaaugcaccuaauucucacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccgaagauggaacaggcagcugugguccaguguauguugauggagcaaacggaguaaagggauuuucauauagguaugguaaugguguuuggauaggaaggaccaaaagucacaguuccagacauggguuugagaugauuugggauccuaauggauggacagagacugauaguaaguucucugugaggcaagauguuguggcaaugacugauuggucaggguauagcggaaguuucguucaacauccugagcugacagggcuagacuguaugaggccgugcuucuggguugaauuaaucaggggacgaccuaaagaaaaaacaaucuggacuagugcgagcagcauuucuuuuuguggcgugaauagugauacuguagauuggucuuggccagacggugcugaguugccauucagcauugacaaguag

SEQ ID NO: 54016 - RNA, 1365 nt, Artificial Sequence
  neuraminidase__InfluenzaA__AGQ48053
augaauccaaaucagaaaauaauaaccauuggaucaaucugucugguagucggacuaauuagccuaauauuacaaauagggaauauaaucucaauauggauuagccauucaauucaaacuggaagucaaaaccauacuggaauaugcaaccaaaacaucauuaccuauaaaaauagcaccuggauaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaagcauucaagugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucaauagaguugaaugcaccuaauucucacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccgaagauggaacaggcagcugugguccaguguauguugauggagcaaacggaguaaagggauuuucauauagguaugguaaugguguuuggauaggaaggaccaaaagucacaguuccagacauggguuugagaugauuugggauccuaauggauggacagagacugauaguaaguucucugugaggcaagauguuguggcaauggcugauuggucaggguauagcggaaguuucguucaacauccugagcugacagggcuagacuguaugaggccgugcuucuggguugaauuaaucaggggacgaccuaaagaaaaaacaaucuggacuagugcgagcagcauuucuuuuuguggcgugaauagugauacuguagauuggucuuggccagacggugcugaguugccauucagcauugacaaguag

SEQ ID NO: 54017 - RNA, 1410 nt, Artificial Sequence
  neuraminidase__InfluenzaA__AGQ81707
augaauccaaaucagaagauaauaaccauugggucaaucuguaugguaauugggauagccaguuugauguuacaaauugggaauaugaucucaauauggguuagucauucaauucagacagggaaucaauaccagccugaaccauguaaucaaaguaucaucacuuaugaaaacaacaccuggguaaaucagacguaugucaacauuagcaauacaaauuuucuuacugagcaggcugugacuucgguggcauuagcgggcaauucaucucuuugcccuauuagugggugggcuauauacaguaaggauaacgguauaagaauuggauccaagggggauguauuuguuauaagagagccauucaucucaugcucccacuuggaaugcagaaccuucuuuuuaacucagggagcucuguugaaugacaagcauucuaauggaaccgucaaagauagaagcccuuacagaaccuuaaugaguugucccgugggugaggcuccuucuccauauaacucaagguuugagucaguugcuuggucagcaagugcuugucaugauggcaucaguugguugacaauuggaauuucugguccggacaauggggcuguggcuguguugaaauacaauggcauaauaacagacacuaucaagaguuggaggaacaacauuuugagaacccaagaaucugaaugugcauguguaaauggcucuugcuuuacuguaaugacugauggaccaaguaaugggcaggcuucauauaaaaucuucaagauagaaaaaggaaaaguagucaaaucaguugaauugaaugcuccuaauuaucacuacgaggaaugcuccuguuauccugaugcaggcaaaaucauguguguaugcagggauaacuggcauggcucaaaucggccgugggugucuuucaaccaaaaucuggaauaucaaauaggauauauaugcaguggaguuuucggggacaauccacgccccaaugauggaacaggcaguugcgguccgguguccucuaauggggcauauggaguaaaaggguuuucauucaaauacgguaaugguguuuggaucggaagaacaaaaagcacuaguuccagaagugguuuugagaugauuugggauccgaauggguggacugaaacggauaguagcuucucaguaaagcaagacaucguagcaauaacugacuggucaggauacagugggaguuuuguccagcauccagaauuaacaggauuagauugcaugagaccuuguuucuggguugagcuaaucagagggcggcccaaagaaaauacaauuuggacuagugggagcagcauauccuuuugugguguagauagugacacuguggguuggucuuggccagacggugcugaguugccauucaccauugacaaguag

SEQ ID NO: 54018 - RNA, 1410 nt, Artificial Sequence
  neuraminidase__InfluenzaA__AGQ81715
augaauccaaaucagaagauaauagcaauugguuccgucucucuaacuauugcgacaauaugccuucucaugcagauugccaucuuaguuacgacuaugacacuacauuucaagcauaaugaaugcaccaacuccucgaauaaucaagcaguaccauguggaccaaucauaauagaaaggaacguaacagagauagugcaucuaaauagcacuaccuuagagaaggaaauuuguccuaaagcagcaggauacagggauuggucaaaaccacaaugucaaaucacaggguucgcuccuuucuccaaggacaauucaauuaggcucuccgcaaguggagauauuugggugacaagggaaccuuauguaucgugcggucuugguaaauguuaucaguuugcacuugggcaggggacuaccuuggacaacagacacucaaacggcacaucacaugauagaacuccuuauaggacacuuuuaaugaaugaguuggguguuccguuucauuuggcgaccaaacaagugugcauagcaugguccagcucaagcugucaugaugggaaagcaugguuacauguuuguguuacuggggaugacagaaaugcaacugccaguaucauuuaugaugguauacuugucgacaguauugguucauggucuaaaaacauccucagaacucaggagucagaauguguuugcaucaaugggaccuguacgguaguaaugacggaugggagugcgucaggaaaagcugacacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaauagacccguucuauauauaaauauggcagauuauaguauugauuccgguuaugugugcucgggacuuguuggugacacaccaagaaaugacgauauaucuagcagcagcaauugcaaggauccuaauaacgagagaggggccccaggagugaaagggugggccuuugacagugggaaugacauuuggaugggaagaacgauugaaaaggauucgcgcucagguuaugagacuuucagggucauuggugguuggaacacugcuaauuccaagucacagacaaguagacaagucauaguugacagugguaauucgucuggguauuccggcauuuucuccauugaaggcaaaagcugcaucaacagguguuuuuauguagagcugauaagagggagaccaaaggagacuagaguaugguggacuucaaauaguaucauuguauucuguggaacuucagguacuuauggaacaggcucauggccugauggggcgaauauuaauuucauggcuauauaa

SEQ ID NO: 54019 - RNA, 1410 nt, Artificial Sequence
  neuraminidase__InfluenzaA__AGQ81717
augaauccaaaucagaagauaauagcaauugguuccgucucucuaacuauugcgacaauaugccuucucaugcagauugccaucuuaguuacgacuaugacaccacauuucaagcaugaugaaugcaccaacuccucgaauaaucaagcagugccauguggaccaaucauaauagaaaggaacguaacagagauagugcauauaaauagcacuaucuuagagaaggaaauuuguccuaaagcagcaggauacaggaauuggucaaaaccacaaugucaaaucauaggguucgcuccuuucuccaaggauaauucaauuaggcucuccgcaaguggcgauauuugggugacaagagaaccuuauguaucgugcggucuugguaaauguuaucaguuugcacuuggacaggggacuaccuuggacaacagacauucaaacggcacaucacaugauaggacuccucauaggacacuuuuaaugaaugaguuggguguuccguuucauuuggcgaccaaacaagugugcauagcauggucuagcucaagcugucaugaugggaaagcaugguuacauguuugugucacuggggaugauagaaaugcaacugccaguaucauuuaugaugguaugcuuguugacaguauugguucauggucuaaaaacauccucagaacucaggagucagaauguguuugcaucaauggaaccuguacgguaguaaugacagauggaagugcgucaggaaaagcugauacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaauagacccguucuauauauaaauauggcagauuauaguauugauuccgguuaugugugcucgggacuuguuggugacacaccaagaaaugacgauauaucuagcagcagcaauugcaaggauccuaauaaugagagaggggccccaggagugaaagggugggccuuugacaguggaaaugacauuuggaugggaagaacgauugaaaaggauucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagagugugguggacuucaaauaguaucauuguauucuguggaacuucagguacuuauggaacaggcucauggccugauggggcaaauaucaauuucauggcuauauaa

SEQ ID NO: 54020 - RNA, 1410 nt, Artificial Sequence
  neuraminidase__InfluenzaA__AGQ81718
augaauccaaaucagaagauaauagcaauugguuccgucucucuaacuauugcgacaauaugccuucucaugcagauugccaucuuaguuacgacuaugacacuacauuucaagcauaaugaaugcaccaacuccucgaauaaucaagcaguaccauguggaccaaucauaauagaaaggaacuuaacagagauagugcaucugaauagcaccaucuuagagaaggaaauuuguccuaaagcagcaggauacaggaauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacacucaaacggcacaucacaugauaggacuccucauagaacacuuuuaaugaaugaguuggguguuccguuucaucugucgaccaaacaagugugcauagcaugguccagcucaagcugucaugaugggaaagcaugguugcauguuuguguuacuggggaugauagaaaugcaacugccagcaucauuuaugaugguauacuuguugacaguauuguuucauggucuaaaaacauccucagaacucaggagucagaauguguuugcaucaauggaacuuguacgguaguaaugacggauggaagugcgucaggaaaagcugacacuagaauacuauuuauuagagaggggaaaaucguacacauuagcccuuugucaggaagugcucagcauguggaggaaugcuccuguuacccccgauauccagaaguuagauguguuugcagagacaauuggaggggaucuaauagaccaguucuauauauaaauauggcagauuauaguauugauuccgguuaugugugcucgggacuuguuggugacacaccgagaaaugacgauacaucuagcagcagcaauugcagggauccuaauaacgagagaggggccccaggagugaaagggugggccuuugacaguggaaaugacauuuggaugggaagaacgauugaaaaggacucgcguucagguuaugagacuuucagggucauuggugguuggaacacugcuaauuccaagucacagacaaguagacaagucauaguugacagugauaauucgucuggguauucugguguuuucuccguugaaggcaaaagcugcaucaacagguguuuuuauguagaguugauaagaggaagaccaaaggagacuagaguaugguggacuucaaauaguaucauuguauuuuguggaacuucagguacuuauggaacaggcucauggccugauggggcaaauaucaauuucauggcuauauaa

SEQ ID NO: 54021 - RNA, 1410 nt, Artificial Sequence
  neuraminidase__InfluenzaA__AGQ81719
augaauccaaaucagaagauaauagcaauugguuccgucucucuaacuauugcgacaauaugccuucucaugcagauugccaucuuaguuacgacuaugacacuacauuucaagcauaaugaaugcaccaacuccucgaauaaucaagcaguaccauguggaccaaucauaauagaaaggaacguaacagagauagugcaucuaaauagcacuaccuuagagaaggaaauuuguacuaaagcagcaggauacagggauuggucaaaaccacaaugucaaaucacaggguucgcuccuuucuccaaggacaauucaauuaggcucucugcaaguggagauauuugggugacaagggaaccuuauguaucgugcggucuugguaaauguuaucaguuugcacuugggcaggggacuaccuuggacaacagacacucaaauggcacaacacaugauagaacuccucauaggacacuuuuaaugaaugaguuggguguuccguuucauuuggcgaccaaacaagugugcauagcaugguccagcucaagcugucaugaugggaaagcaugguuacauguuuguguuacuggggaugacagaaaugcaacugccaguaucauuuaugaugguauacuugucgacaguauugguucauggucuaaaaacauccucagaacucaggagucagaauguguuugcaucaaugggaccuguacgguaguaaugacggaugggagugcgucaggaaaagcugacacuagaauacuauuuauuagagaggggaaaaucguacacauuagcccuuugucaggaagugcucagcauguggaggaaugcuccuguuacccccaauauccagaaguuagauguguuugcagagacaauuggaggggaucuaauagacccguucuauauauaaauauggcagauuauaguauugauuccgguuaugugugcucgggacuuguuggugacacaccaagaaaugacgauauaucuagcaacagcaauugcaaggauccuaauaacgagaguggggccccaggagugaaagggugggccuuugacagugggaaugacauuuggaugggaagaacgauugaaaaggauucgcgcucagguuaugagacuuucagggucauuggugguuggaacacugcuaauuccaagucacagacaaguagacaagucauaguugacagugauaauucgucuggguauuccggcauuuucuccauugaaggcaaaagcugcaucaacagguguuuuuauguagagcugauaagagggagaccaaaggagacuagaguaugguggacuucaaauaguaucauuguauucuguggaacuucagguacuuauggaacaggcucauggccugauggggcgaauauuaauuucauggcuauauaa

SEQ ID NO: 54022 - RNA, 1410 nt, Artificial Sequence
  neuraminidase__InfluenzaA__AGQ81722
augaauccaaaucagaagauaauagcaauugguuccgucucucuaacuauugcgacaauaugccuucucaugcagauugccaucuuaguuacgacuaugacaccacauuucaagcaugaugaaugcaccaacuccucgaauaaucaagcagugccauguggaccaaucauaauagaaaggaacguaacagagauagugcauauaaauagcacuaucuuagagaagggaauuuguccuaaagcagcaggauacaggaauuggucaaaaccacaaugucaaaucauaggguucgcuccuuucuccaaggauaauucaauuaggcucuccgcaaguggcgauauuugggugacaagagaaccuuauguaucgugcggucuugguaaauguuaucaguuugcacuuggacaggggacuaccuuggacaacagacauucaaacggcacaucacaugauaggacuccucauaggacacuuuuaaugaaugaguuggguguuccguuucauuuggcgaccaaacaagugugcauagcauggucuagcucaagcugucaugaugggaaagcaugguuacauguuugugucacuggggaugauagaaaugcaacugccaguaucauuuaugaugguaugcuuguugacaguauugguucauggucuaaaaacauccucagaacucaggagucagaauguguuugcaucaauggaaccuguacgguaguaaugacagauggaagugcgucaggaaaagcugauacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaauagacccguucuauauauaaauauggcagauuauaguauugauuccgguuaugugugcucgggacuuguuggugacacaccaagaaaugacgauacaucuagcagcagcaauugcaaggauccuaauaaugagagaggggccccaggagugaaagggugggccuuugacaguggaaaugacauuuggaugggaagaacgauugaaaaggauucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagagugugguggacuucaaauaguaucauuguauucuguggaacuucagguacuuauggaacaggcucauggccugauggggcaaauaucaauuucauggcuauauaa

SEQ ID NO: 54023 - RNA, 1410 nt, Artificial Sequence
  neuraminidase__InfluenzaA__AGQ81724
augaauccaaaucagaagauaauagcaauugguuccgucucucuaacuauugcgacaauaugccuucucaugcagauugccaucuuaguuacgacuaugacacuacauuucaagcauaaugaaugcuccaacuccucgaauaaucaagcaguaccauguggaccaaucauaauagaaaggaacguaacagagauagugcaucuaaauagcacuaccuuagagaaggaaauuuguccuaaagcagcaggauacagggauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacacucaaacggcacaucacaugauaggacuccucauaggacacuuuuaaugaaugaguuggguguuccguuucaucuggcgaccaaacaagugugcauagcaugguccagcucaagcugucaugaugggaaagcaugguuacauguuuguguuacuggggaugacagaaaugcaacugccaguaucauuuaugaugguauacuuguugacaguauugguucauggucuaaaaacauccucagaacucaggagucagaauguguuugcaucaaugggaccuguacgguaguaaugacggauggaagugcgucaggaaaagcugacacuagaauacuauuuauuagagaggggaaaaucguacacauuagcccuuugucaggaagugcucagcauguggaggaaugcucuuguuacccccaauauccagaaguuagguguguuugcagagacaauuggaggggaucuaauagacccguucuauauauaaacauggaagauuauaguauugauucugguuaugugugcucgggacuuguuggugacacaccaagaaaugacgauauaucuagcagcagcaauugcaaggauccuaauaacgagagaggggccccaggagugaaagggugggccuuugacaguggaaaugaccuuuggaugggaagaacgauugaaaaggauucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagaguaugguggacuucaaauaguaucauuguauucuguggaacuucagguacuuauggaacaggcucauggccugauggggcgaauaucaauuucauggcuauauaa

SEQ ID NO: 54024 - RNA, 1410 nt, Artificial Sequence
  neuraminidase__InfluenzaA__AGQ81726
augaauccaaaucagaagauaauagcaauugguucugucucucuaacuauugcgacaauaugccuucucaugcagauugccaucuuaguuacgacuaugacacuacauuucaagcauaaugaaugcuccaacuccucgaauaaucaagcaguaccauguggaccaaucauaauagaaaggaacauaacagagauagugcaucuaaauagcacuaccuuagagaaggaaauuuguccuaaagcagcaggauacagggauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacacucaaacggcacaucacaugauaggacuccucauaggacacuuuuaaugaaugaguuggguguuccguuucauuuggcgaccaaacaagugugcauagcaugguccagcucaagcugucaugaugggaaagcaugguuacauguuuguguuacuggggaugacagaaaugcaacugccaguaucauuuaugaugguauacuuguugacaguauugguucauggucuaaaaacauccucagaacucaggagucagaaugugucugcaucaaaaggaccuguacgguaguaaugacggauggaagugcgucaggaaaagcugacacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaauagacccguucuauauauaaauauggcagauuauaguauugauucugguuaugugugcucgggacuuguuggugacacaccaagaaaugacgauauaucuagcagcagcaauugcaaggauccuaauaacgagagaggggccccaggagugaaagggugggccuuugacaguggaaaugaccuuuggaugggaagaacgauugaaaaggaaucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagaguaugguggacuucaaauaguaucauuguauucuguggaacuucagguacuuauggaacaggcucauggccugauggggcgaauaucaauuucauggcuauauaa

SEQ ID NO: 54025 - RNA, 1410 nt, Artificial Sequence
  neuraminidase__InfluenzaA__AGQ81727
augaauccaaaucagaagauaauagcaauugguucugucucucuaacuauugcgacaauaugccuucucaugcagguugccaucuuaguuacgacuaugacacuacauuucaagcauaaugaaugcuccaacuccucgaauaaucaagcaguaccauguggaccaaucauaauagaaaggaacauaacagagauagugcaucuaaauagcacuaccuuagagaaggaaauuuguccuaaagcagcaggauacagggauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacacucaaacggcacaucacaugauaggacuccucauaggacacuuuuaaugaaugaguuggguguuccguuucauuuggcgaccaaacaagugugcauagcaugguccagcucaagcugucaugaugggagagcaugguuacauguuuguguuacuggggaugacagaaaugcaacugccaguaucauuuaugaugguauacuuguugacaguauugguucauggucuaaaaacauccucagaacucaggagucagaauguguuugcaucaaugggaccuguacgguaguaaugacggauggaagugcgucaggaaaagcugacacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaauagacccguucuauauauaaauauggcagauuauaguauugauucugguuaugugugcucgggacuuguuggugacacaccaagaaaugacgauauaucuagcagcagcaauugcaaggauccuaauaacgagagaggggccccaggagugaaagggugggccuuugacaguggaaaugaccuuuggaugggaagaacgauugaaaaggaaucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggaggccaaaggagacuagaguaugguggacuucaaauaguaucauuguauucuguggaacuucagguacuuauggaacaggcucauggccugauggggcgaauaucaauuucaugccuauauaa

SEQ ID NO: 54026 - RNA, 1410 nt, Artificial Sequence
  neuraminidase__InfluenzaA__AGQ81728
augaauccaaaucagaagauaguagcaauuggcucuguuucccuaacuauugcgacaaugugccuccucaugcagaucgcccucuuugcuacaacuaugacacuacauuucaagcagacgggaagcacaaacuccucugacaaucaagcagugccauguggaccaaucauaauagaaaggaacauaacagaaauagugcauuugaauagcaccacuuuagaaaaggaaacuuguccuaaaucagcaggguacaggaauuggucuaaaccacaaugucaaaucacaggauucgcuccuuucuccaaggacaauucaauuaggcucuccgcagguggagauauuugggugacaagagaaccuuaugugucaugcggucuugguaaauguuaucaauuugcacuugggcaggggaccaccuuggacaacaaacacucaaacggcacaacauaugauagaacuccucauagaacccuuuuaaugaaugaguuggguguuccguuucauuuggcaaccaaacaaguguguauagcaugguccagcucaagcugccaugaugggaaagcaugguuacauguuugugucacuggggaugauaaaaaugcaacugcuaguaucauuuaugaugggauacuuguugacagcauugcuucauggucuaaaaacauccucagaacucaggagucagaaugcguuuguaucaauggaaccuguacgguaguaaugacggauggaagugcaucaggaagggcugacaccagaauacuauuuauuagagaggggaaaaucguacacaucagcccauugucaggaagugcucagcauguugaggaaugcuccuguuacccccgauauccagaaguuagauguguuugcagagacaauuggaagggauccaauagacccguucuauauauaaauauggcagauuauaguauugauuccaguuauguguguucagggauuguuggcgacacaccaagaaaugaugauagaucuagcagcagcaacugcagagauccuaauaacgaaauaggagccccaggagugaaagggugggccuucgacagugggaaugauauuuggaugggaagaacgaucgaaaaggauucgcgcucagguuaugagacuuucagggucauuggugguuggagcacagcuaauuccaagucacagauaaauagacaagucauaguugaccgugauaacucgucuggguauucugguauuuucucuguugaaggcaaaagcugcaucaacagguguuuuuauguagaguugauaagaggaagaccaaaagagaauagagugugguggacuucaaauagcaucauuguauuuuguggaacuucagguacuuauggaacaggcucauggccugauggggcgaauaucaaucucaugccgauauaa

SEQ ID NO: 54027 - RNA, 1410 nt, Artificial Sequence
  neuraminidase__InfluenzaA__AGQ81729
augaauccaaaucagaagauaauagcaauugguuccgucucucuaacuauugcgacaauaugccuucucaugcagauugccaucuuaguugcgacuaugacacuacauuccaagcauggugaaugcaccaacuccucgaauaaucaagcagugccauguggaccaaucauaauagaaaggaacguaacagagauagugcaucuaaauagcacuaccuuagagaaggaaauuuguccuaaagcagcaggauacagggauuggucaaaaccacaaugucaaaucacaggguucgcuccuuucuccaaggauaauucaauuaggcucuccgcaaguggcgauauuugggugacaagagaaccuuauguaucgugcggucuugguaaauguuaucaguuugcacuuggacaggggacuaccuuggacaacagacauucaaacggcacaucacaugauaggacuccucauaggacacuuuuaaugaaugaguuggguauuccguuucauuuggcgaccaaacaagugugcauagcauggucuagcucaagcugucaugaugggaaagcaugguuacauguuugugucacuggggaugauaggaaugcaacugccaguaucauuuaugaugguaugcuuguugacaguauugguucauggucuaaaaacauccucagaacucaggagucagaauguguuugcaucaauggaaccuguacgguaguaaugacagauggaagugcgucaggaaaagcugauacuagaauacuauucauuagagaggggaaaaucguacacauuagcccuuuguuaggaagugcucagcauguggaggaaugcuccuguuacccccaauauccagaaguuagguguguuugcagagacaauuggaggggaucuaauagacccguucuauauauaaauauggcagauuauaguguugauuccgguuaugugugcucgggacuuguuggugacacaccaagaaaugacgauacaucuagcagcagcaauugcaaggauccuaauaaugagagaggggccccaggagugaaagggugggccuuugacaguggaaaugacauuuggaugggaagaacgauugaaaaggauucgcgcucagguuaugagacuuucagggucauuggugguuggaacaccgcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagagugugguggacuucaaauaguaucauuguauucuguggaacuucagguacuuacggaacaggcucauggccugauggggcaaauaucaauuucaugccuauauaa

SEQ ID NO: 54028 - RNA, 1410 nt, Artificial Sequence
  neuraminidase__InfluenzaA__AGQ81730
augaauccaaaucagaagauaauagcaauugguuccgucucucuaacuauugcgacaauaugucuucucaugcagauugccaucuuaguuacgacuaugacacuacauuucaagcauaaugaaugcaucaacuccucgaauaaucaaucagugccauguggaccaaucauaauagaaaggaacguaacagagauagugcaucuaaauagcacuaccuuagagaaggaaauuuguccuaaagcagcaggauacagggauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacauucaaacggcacaucacaugauaggacuccucauaggacacuuuuaaugaaugaguuggguguuccguuucauuuggcgagcaaacaagugugcauagcauggucuagcucaagcugucaugaugggaaagcaugguuacauguuugugucacuggggaugauagaaaugcaacugccaguaucauuuaugaugguaugcuuguugacaguauugguucauggucuaaaaacauccucagaacucaggagucagaguguguuugcaucaauggaaccuguacgguaguaaugacagauggaagugcgucaggagaagcugacacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaauagacccguucuauauauaaauauggcagauuauaguauugauuccgguuaugugugcucgggacuuguuggugacacaccaagaaaugacgauauaucuagcagcagcaauugcaaggauccuaauaaugagagaggggccccaggagugaaagggugggccuuugacaguggaaaugacauuuggaugggaagaacgauugaaaaggauucacgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagagugugguggacuucaaauaguaucauuguguucuguggaacuucagguacuuauggaacaggcucauggccugauggggcaaauaucaauuucauggcuauauaa

SEQ ID NO: 54029 - RNA, 1410 nt, Artificial Sequence
  neuraminidase__InfluenzaA__AGQ81731
augaauccaaaucagaagauaauagcaauugguucugucucucuaacuauugcgacaauaugccuucucaugcagauugccaucuuaguuacgacuaugacacuacauuucaagcauaaugaaugcuccaacuccucgaauaaucaagcaguaccauguggaccaaucauaauagaaaggaacauaacagagauagugcaucuaaauagcacuaccuuagagaaggaaauuuguccuaaaacagcaggauacagggauuggucaaaaccacaaugucaaaucacaggguucgcuccuuucuccaaggacaauucaauuaggcucuccgcaaguggagauauuugggugacaagagaaccuuauguaucgugcgguuuugguaaauguuaucaguuugcacuugggcaggggacuaccuuggacaacagacacucaaacggcacaucacaugauaggacuccucauaggacacuuuuaaugaaugaguuggguguuccguuucauuuggcgaccaaacaagugugcauagcaugguccagcucaagcugucaugaugggaaagcaugguuacauguuuguguuacuggggaugacagaaaugcaacugccaguaucauuuaugaugguauacuuguugacaguauugguucauggucuaaaaacauccucagaacucaggagucagaauguguuugcaucaaugggaccuguacgguaguaaugacggauggaagugcgucaggaaaagcugacacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaauagacccguucuauauauaaauaugacagauuauaguauugauucugguuaugugugcucgggacuuguuggugacacaccaagaaaugacgauauaucuagcagcagcaauugcaaggauccuaauaacgagagaggggccccaggagugaaagggugggccuuugacaguggaaaugaccuuuggaugggaagaacgauugaaaaggaaucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagaguaugguggacuucaaauaguaucauuguauucuguggaacuucagguacuuauggaacaggcucauggccugauggggcgaauaucaauuucauggcuauauaa

SEQ ID NO: 54030 - RNA, 1410 nt, Artificial Sequence
  neuraminidase__InfluenzaA__AGQ81732
augaauccaaaucagaagauaauagcaauugguucugucucucuaacuauugcgacaauaugccuucucaugcagguugccaucuuaguuacgacuaugacacuacauuucaagcauaaugaaugcuccaacuccucgaauaaucaagcaguaccauguggaccaaucauaauagaaaggaacauaacagagauagugcaucuaaauagcacuaccuuagagaaggaaauuuguccuaaagcagcaggauacagggauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacacucaaacggcacaucacaugauaggacuccucauaggacacuuuuaaugaaugaguuggguguuccguuucauuuggcgaccaaacaagugugcauagcaugguccagcucaagcugucaugaugggaaagcaugguuacauguuuguguuacuggggaugacagaaaugcaacugccaguaucauuuaugaugguauacuuguugacaguauugguucauggucuaaaaacauccucagaacucaggagucagaauguguuugcaucaaugggaccuguacgguaguaaugacggauggaagugcgucaggaaaagcugacacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaauagacccguucuauauauaaauauggcagauuauaguauugauucugguuaugugugcucgggacuuguuggugacacaccaagaaaugacgauauaucuagcagcagcaauugcaaggauccuaauaacgagagaggggccccaggagugaaagggugggccuuugacaguggaaaugaccuuuggaugggaagaacgauugaaaaggaaucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagaguaugguggacuucaaauaguaucauuguauucuguggaacuucagguacuuauggaacaggcucauggccugauggggcgaauaucaauuucaugccuauauaa

SEQ ID NO: 54031 - RNA, 1410 nt, Artificial Sequence
  neuraminidase__InfluenzaA__AGQ81733
augaauccaaaucagaagauaauagcaauugguuccgucucucuaacuauugcgacaauaugccuucucaugcagauugccaucuuaguuacgacuaugacacuacauuucaagcauaaugaaugcuccaacuccucgaauagucaagcaguaccauguggaccaaucauaauagaaaggaacguaacagagauagugcaucuaaauagcacuaccuuagagaaggaaauuuguccuaaagcagcagaauacagggauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacacucaaacggcacaucacaugauaggacuccucauaggacacuuuuaaugaaugaguuagguguuccguuucauuuggcgaccaaacaagugugcauagcaugguccagcucaagcugucaugaugggaaagcaugguuacauguuuguguuacuggggaugacagaaaugcaacugccaguaucauuuaugaugguauacuuguugacaguauugguucauggucuaaaaacauccucagaacucaggagucagaauguguuugcaucaaugggaccuguacgguaguaaugacggauggaagugcgucaggaaaagcugacacuagaauacuauuuauuagagaggggaaaaucguacacauuagcccuuugucaggaagugcucagcauguggaggaaugcucuuguuacccccaauauccagaaguuagguguguuugcagagacaauuggaggggaucuaauagacccguccuauauauaaacauggcagauuauaguauugauucugguuaugugugcucgggacuuguuggugacacaccaagaaaugacgauauaucuagcagcagcaauugcaaggauccuaauaacgagagaggggccccaggagugaaagggugggccuuugacaguggaaaugaccuuuggaugggaagaacgauugaaaaggauucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagaguaugguggacuucaaauaguaucauuguauucuguggaacuucagguacuuauggaacaggcucauggccugauggggcgaauaucaauuucaugccuauauaa

SEQ ID NO: 54032 - RNA, 1410 nt, Artificial Sequence
  neuraminidase__InfluenzaA__AGQ81734
augaauccaaaucagaagauaauagcaauugguucugucucucuaacuauugcgacaauaugccuucucaugcagauugccaucuuaguuacgacuaugacacuacauuucaagcauaaugaauacuccaacuccucgaauaaucaagcaguaccauguggaccaaucauaauagaaaggaacauaacagagauagugcaucuaaauagcacuaccuuagagaaggaaauuuguccuaaagcagcaggauacagggauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacacucaaacggcacaucacaugauaggacuccucauaggacacuuuuaaugaaugaguuggguguuccguuucauuuggcgaccaaacaagugugcauagcaugguccagcucaagcugucaugaugggaaagcaugguuacauguuuguguuacuggggaugacagaaaugcaacugccaguaucauuuaugaugguauacuuguugacaguauugguucauggucuaaaaacauccucagaacucaggagucaaaaugugucugcaucaaaaggaccuguacgguaguaaagacggauggaagugcgucaggaaaagcugacacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaauagacccguucuauauauaaauauggcagauuauaguauugauucugguuaugugugcucgggacuuguuggugacacaccaagaaaugacgauauaucuagcagcagcaauugcaaggauccuaauaacgagagaggggccccaggagugaaagggugggccuuugacaguggaaaugaccuuuggaugggaagaacgauugaaaaggaaucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagaguaugguggacuucaaauaguaucauuguauucuguggaacuucagguacuuauggaacaggcucauggccugauggggcgaauaucaauuucauggcuauauaa

SEQ ID NO: 54033 - RNA, 1410 nt, Artificial Sequence
  neuraminidase__InfluenzaA__AGQ81735
augaauccaaaucagaagauaauagcaauugguuccgucucucuaacuauugcgacaauaugccuucucaugcagauugccaucuuaguuacgacuaugacacuacauuucaagcauaaugaaugcuccaacuccucgaauagucaagcaguaccauguggaccaaucauaauagaaaggaacguaacagagauagugcaucuaaauagcacuaccuuagagaaggaaauuuguccuaaagcagcagaauacagggauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacacucaaacggcacaucacaugauaggacuccucauaggacacuuuuaaugaaugaguuggguguuccguuucauuuggcgaccaaacaagugugcauagcaugguccagcucaagcugucaugaugggaaagcaugguuacauguuuguguuacuggggaugacagaaaugcaacugccaguaucauuuaugaugguauacuuguugacaguauugguucauggucuaaaaacauccucagaacucaggagucagaauguguuugcaucaaugggaccuguacgguaguaaugacggauggaagugcgucaggaaaagcugacacuagaauacuauuuauuagagaggggaaaaucguacacauuagcccuuugucaggaagugcucagcauguggaggaaugcucuuguuacccccaauauccagaaguuagguguguuugcagagacaauuggaggggaucuaauagacccguccuauauauaaacauggcagauuauaguauugauucugguuaugugugcucgggacuuguuggugacacaccaagaaaugacgauauaucuagcagcagcaauugcaaggauccuaauaacgagagaggggccccaggagugaaagggugggccuuugacaguggaaaugaccuuuggaugggaagaacgauugaaaaggauucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagaguaugguggacuucaaauaguaucauuguauucuguggaacuucagguacuuauggaacaggcucauggccugauggggcgaauaucaauuucaugccuauauaa

SEQ ID NO: 54034 - RNA, 1410 nt, Artificial Sequence
  neuraminidase__InfluenzaA__AGQ81736
augaauccaaaucagaagauaauagcaauugguuccgucucucuaacuauugcgacaauaugccuucucaugcagauugccaucuuaguugcaacuaugacacuacauuccaagcauggugaaugcaccgacuccucgaauaaucaagcagugccauguggaccaaucauaauagaaaggaacguaacagagauagugcaucuaaauagcacuaccuuagagaaggaaauuuguccuaaagcagcaggauacaaggauuggucaaaaccacaaugucaaaucacaggguucgcuccuuucuccaaggauaauucaauuaggcucuccgcaaguggcgauauuugggugacaagagaaccuuauguaucgugcggucuugguaaauguuaucaguuugcacuuggacaggggacuaccuuggacaacagacauucaaacggcacaucacaugauaggacuccucauaggacacuuuuaaugaaugaguuggguguuccguuucauuuggcgaccaaacaagugugcauagcauggucuagcucaagcugucaugaugggaaagcaugguuacauguuugugucacuggggaugauaggaaugcaacugccaguaucauuuaugaugguaugcuuguugacaguauugguucauggucuaaaaacauccucagaacucaggagucagaauguguuugcaucaauggaaccuguacuguaguaaugacagauggaagugcgucaggaaaagcugauacuagaauacuauucauuagagaggggaaaaucgcacacauuagcccuuugucaggaagugcucagcauguggaggaaugcuccuguuacccccaauauccagaaguuagguguguaugcagagacaauuggaggggaucuaauagacccguucuauauauaaauauggcagauuauaguguugauuccgguuaugugugcucgggacuuguuggugacacaccaagaaaugacgauacaucuagcagcagcaauugcaaggauccuaauaaugagagaggggccccaggagugaaagggugggccuuugacaguggaaaugacauuuggaugggaagaacgauugaaaaggauucgcgcucagguuaugagacuuucagggucauuggugguuggaacaccgcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagagugugguggacuucaaauaguaucauuguauucuguggaacuucagguacuuauggaacaggcucauggccugauggggcaaauaucaauuucaugccuauauaa

SEQ ID NO: 54035 - RNA, 1410 nt, Artificial Sequence
  neuraminidase__InfluenzaA__AGQ81737
augaauccaaaucagaagauaauagcaauugguucugucucucuaacuauugcgacaauaugccuucucaugcagauugccaucuuaguuacgacuaugacacuacauuucaagcauaaugaaugcuccaacuccucgaauaaucaagcaguaccauguggaccaaucauaauagaaaggaacauaacagagauagugcaucuaaauagcacuaccuuagagaaggaaauuuguccuaaagcagcaggauacagggauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacacucaaacggcacaucacaugauaggacuccucauaggacacuuuuaaugaaugaguuggguguuccguuucauuuggcgaccaaacaagugugcauagcaugguccagcucaagcugucaugaugggaaagcaugguuacauguuuguguuacuggggaugacagaaaugcaacugccaguaucauuuaugaugguauacuuguugacaguauugguucauggucuaaaaacauccucagaacucaggagucagaauguguuugcaucaaugggaccuguacgguaguaaugacggauggaagugcgucaggaaaagcugacacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaauagacccguucuauauauaaauauggcagauuauaguauugauucugguuaugugugcucgggacuuguuggugacacaccaagaaaugacgauauaucuagcagcagcaauugcaaggauccuaauaacgagagaggggccccaggagugaaagggugggccuuugacaguggaaaugaccuuuggaugggaagaacgauugaaaaggaaucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagaguaugguggacuucaaauaguaucauuguauucuguggaacuucagguacuuauggaacaggcucauggccugauggggcgaauaucaauuucauggcuauauaa

SEQ ID NO: 54036 - RNA, 1410 nt, Artificial Sequence
  neuraminidase__InfluenzaA__AGQ81738
augaauccaaaucagaagauaauagcaauugguucugucucucuaacuauugcgacaauaugccuucucaugcagguugccaucuuaguuacgacuaugacacuacauuucaagcauaaugaaugcuccaacuccucgaauaaucaagcaguaccauguggaccaaucauaauagaaaggaacauaacagagauagugcaucuaaauagcacuaccuuagagaaggaaauuuguccuaaagcagcaggauacagggauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacacucaaacggcacaucacaugauaggacuccucauaggacacuuuuaaugaaugaguuggguguuccguuucauuuggcgaccaaacaagugugcauagcaugguccagcucaagcugucaugaugggaaagcaugguuacauguuuguguuacuggggaugacagaaaugcaacugccaguaucauuuaugaugguauacuuguugacaguauugguucauggucuaaaaacauccucagaacucaggagucagaauguguuugcaucaaugggaccuguacgguaguaaugacggauggaagugcgucaggaaaagcugacacuagaauacuauuuauuagagaggggaaaaucauacacauuagcccuuugucaggaagugcucagcauguggaggaaugcuccuguuacccccaauauccagaaguuagguguguuugcagagacaauuggaggggaucuaauagacccguucuauauauaaauauggcagauuauaguauugauucugguuaugugugcucgggacuuguuggugacacaccaagaaaugacgauauaucuagcagcagcaauugcaaggauccuaauaacgagagaggggccccaggagugaaagggugggccuuugacaguggaaaugaccuuuggaugggaagaacgauugaaaaggaaucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagaguaugguggacuucaaauaguaucauuguauucuguggaacuucagguacuuauggaacaggcucauggccugauggggcgaauaucaauuucaugccuauauaa

SEQ ID NO: 54037 - RNA, 1410 nt, Artificial Sequence
  neuraminidase__InfluenzaA__AGQ81739
augaauccaaaucagaagauaauagcaauugguuccgucucucuaacuauugcgacaauaugccuucucaugcagauugccaucuuaguuacgacuaugacacuacauuucaagcaugaugaaugcaccaacuccucgaauaaucaagcagugccaugugaaccaaucauaauagaaaggaacguaacagagauagugcauauaaauagcacuaucuuagagaaggaaauuuguccuaaagcagcaggauacaggaauuggucaaaaccacaaugucaaaucacaggguucgcuccuuucuccaaagauaauucaauuaggcucuccgcaaguggcgauauuugggugacaagagaaccuuauguaucgugcggucuugguaaauguuaucaguuugcacuuggacaggggacuaccuuggacaacagacauucaaacggcacauuaaaugauaggacuccucauaggacacuuuuaaugaaugaguuggguguuccguuucauuuggcgaccaaacaagugugcauagcauggucuagcucaagcugucaugaugggaaagcaugguuacauguuugugucacuggggaugauagaaaugcaacugccaguaucauuuaugaugauaugcuuguugacaguauugguucauggucuaaaaacauccucagaacucaggagucagaauguguuugcaucaauggaaccuguacgguaguaaugacagauggaagugcgucaggaaaagcugauacuagaauacuauuuauuagagaagggaaaaucguacacauuagcccuuugucaggaagugcucagcauguggaggaaugcuccuguuacccccaauacccagaaguuagguguguuugcagagacaauuggaggggaucuaauagacccguucuauauauaaauauggcagauuauaguauugauuccgguuaugugugcucgggacuuguuggugacacaccaagaaaugacgauauaucuagcagcagcaauugcaaggauccuaauaaugagagaggggccccaggagugaaagggugggccuuugacaguggaaaugacauuuggaugggaagaacgauugaaaaggauucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagagugugguggacuucaaauaguaucauuguauucuguggaacuucagguacuuauggaacaggcucauggccugauggggcaaauaucaauuucauggcuauauaa

SEQ ID NO: 54038 - RNA, 1410 nt, Artificial Sequence
  neuraminidase__InfluenzaA__AGQ81740
augaauccaaaucagaagauaguagcaauugguucugucucucuaacuauugcgacaauaugccuucucaugcagauugccaucuuaguuacgacuaugacacuacacuucaagcauggugaaugcaccaacuccucgaauaaucaagcagugccauguggaccaaucauaauagaaaggaacauaacagagauagugcaucuaaauagcacuaccuuagagaaggaaauuuguccuaaagcagcaggauacagggauuggucaaaaccacaaugucaaaucacaggguucgcuccuuucuccaaggauaauucaauuaggcucuccgcaaguggcgauauuugggugacaagagaaccuuauguaucguguggucuugguaaauguuaucaguuugcacuuggacaggggacuaccuuggacaacagacauucaaacggcacaucacaugauaggacuccucauaggacacuuuuaaugaaugaguuagguguuccguuucauuuggcgaccaaacaagugugcauagcauggucuagcucaagcugucaugaugggaaagcaugguuacauguuugugucaccggggacgauagaaaugcaacugccaguaucauuuauaaugguauacuuguugacaguauugguucauggucuaaaaacauccucagaacucaggagucagaauguguuugcaucaauggaaccuguacgguaguaaugacagauggaagugcgucaggaaaagcugauacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaaucgacccguucuauauauaaauauggcggauuauaguguugauuccgguuaugugugcucgggacuuguuggugacacaccuagaaaugacgauacaucuagcagcagcaauugcaaggauccuaauaaugagagaggggccccaggagugaaagggugggccuuugacaguggaaaugacauuuggaugggaagaacgauugaaaaggauuugcgcucagguuaugagacuuucagggucauuggugguuggaacacugcuaauuccaagucacagacaaguagacaagucauaguugauagugacaauucgucuggguauucuggcauuuucuccguugaaggcaaaagcugcaucaacagguguuuuuauguagaguugauaagagggagaccaaaggagacuagagugugguggacuucaaauaguaucauuguauucuguggaacuucagguacuuauggaacaggcucauggccugauggggcaaauaucaauuucaugccuauauaa

SEQ ID NO: 54039 - RNA, 1410 nt, Artificial Sequence
  neuraminidase__InfluenzaA__AGQ81741
augaauccaaaucagaagauaguagcaauugguuccgucucucuaaccauugcgacaauaugccuucucaugcagauugccaucuuaguuacgacuaugacacuacacuucaagcauggugaaugcaccaacuccucgaauaaucaagcagugccauguggaccaaucauaauagaaaggaacauaacagagauagugcaucuaaauagcacuaccuuagauaaggaaauuuguccuaaagcagcaggauacagggauuggucaaaaccacaaugucaaaucacaggguucgcuccuuucuccaaggauaauucaauuaggcucucugcaaguggcgauauuugggugacaagagaaccuuauguaucgugcggucuugguaaauguuaucaguuugcacuuggacaggggacuaccuuggacaacaggcauucaaacggcacaucacaugauaggacuccucauaggacacuuuuaaugaaugaguuagguguuccguuucauuuggcgaccaaacaagugugcauagcauggucuagcucaagcugucaugaugggaaagcaugguuacauguuugugucacuggggaugauagaaaugcaacugccaguaucauuuaugaugguaugcuuguugacaguauugguucauggucuaaaaacauccucagaacucaggagucagaauguguuugcaucaauggaaccuguacgguaguaaugacagauggaagugcgucaggaaaagcugauacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaaucgacccguucuauauauaaauauggcggauuauaguguugauucagguuaugugugcucgggacuuguuggugacacaccuagaaaugacgauacaucuagcagcagcaauugcaaggauccuaauaaugagagaggggccccaggagugaaagggugggccuuugacaguggaaaugacauuuggaugggaagaacgauugaaaaggauuugcgcucagguuaugagacuuucagggucauuggugguuggaacacugcuaauuccaagucacagacaaguagacaagucauaguugacagugacaauucgucuggguauucuggcauuuucuccguugaaggcaaaagcugcaucaacagguguuuuuauguagaguugauaagagggagaccaaaggagacuagagugugguggacuucaaauaguaucauuguauucuguggaacuucagguacuuauggaacaggcucauggccugauggggcaaauaucaauuucaugccuauauaa

SEQ ID NO: 54040 - RNA, 1410 nt, Artificial Sequence
  neuraminidase__InfluenzaA__AGQ81742
augaauccaaaucagaagauaguagcaauugguucugucucucuaacuauugcgacaauaugccuucucaugcagauugccaucuuaguuacgacuaugacacuacacuucaagcauggugaaugcaccaacuccucgaauaaucaagcagugccauguggaccaaucauaauagaaaggaacauaacagagauagugcaucuaaauagcacuaccuuagagaaggaaauuuguccuaaagcagcagaauacagggauuggucaaaaccacaaugucaaaucacaggguucgcuccuuucuccaaggauaauucaauuaggcucuccgcaaguggcgauauuugggugacaagagaaccuuauguaucguguggucuugguaaauguuaucaguuugcacuuggacaggggacuaccuuggacaacagacauucaaacggcacaucacaugauaggacuccucauaggacacuuuuaaugaaugaguuagguguuccguuucauuuggcgaccaaacaagugugcauagcauggucuagcucaagcugucaugaugggaaagcaugguuacauguuugugucacuggggacgauagaaaugcaacugccaguaucauuuaugaugguaugcuuguugacaguauugguucauggucuaaaaacauccucagaacucaggagucagaauguguuugcaucaauggaaccuguacgguaguaaugacagauggaagugcgucaggaaaagcugauacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaaucgacccguucuauauauaaauauggcggauuauaguguugauuccgguuaugugugcucgggacuuguuggugacacaccuagaaaugacgauacaucuagcagcagcaauugcaaggauccuaauaaugagagaggggccccaggagugaaagggugggccuuugacaguggaaaugacauauggaugggaagaacgauugaaaaggauuugcgcucagguuaugagacuuucagggucauuggugguuggaacacugcuaauuccaagucacagacaaguagacaagucauaguugacagugacaauucgucuggguauucuggcauuuucuccguugaaggcaaaagcugcaucaacagguguuuuuauguagaguugauaagagggagaccaaaggagacuagagugugguggacuucaaauaguaucauuguauucuguggaacuucagguacuuauggaacaggcucauggccugauggggcaaauaucaauuucaugccuauauaa

SEQ ID NO: 54041 - RNA, 1410 nt, Artificial Sequence
  neuraminidase__InfluenzaA__AGQ81744
augaauccaaaucagaagauaauagcaauugguuccgucucucuaacuauugcgacaauaugccugcucaugcagauugccauauuaguuacgacuaugacacuacauuucaggcacgaugaaugcaccaacuccucaaacaaucaagcagugccauguggaccaaucauaauagaaaggaacguaacagagauagugcaucuaaauagcacuaccuuagaaaaggaaauuuguccuaaagcagcagaauacagggauuggucaaaaccacaaugucaaaucacaggguucguuccuuucuccaaggauaauucaauuaggcucuccgcagguggcgauauuugggugacaagagaaccuuauguaucgugcggucuugguaaauguuaucaguuugcacuuggacaggggacuaccuuggacaacagacauucaaacggcacaucacaugauaggacuccucauaggacacuuuuaaugaaugaguuggguguuccauuucauuuggcgaccaaacaggugugcauagcauggucuagcucaagcugucaugaugggaaagcaugguuacauguuuguguuacuggggaugauagaaaugcaacugccaguauuauuuaugaugguaugcuuguugacaguauugguucauggucuaaaaacauccucagaacccaggagucagaauguguuugcaucaauggaaccuguacgguaguaaugacagauggaagcgcgucaggaaaagcugauacuagaauacuauuuauuagagagggaaaaauuguacacauuagcccuuugucaggaagugcucagcauguggaggaaugcuccuguuauccccaauauccagaaguuagguguguuugcagagacaauuggaggggaucuaauagacccguucuauauauaaauguggcagauuauaguguugauuccgguuaugugugcucgggacuuguuggugacacaccaagaaaugacgauauaucuagcagcagcaauugcaaggauccuaauaaugagagaggggccccaggagugaaagggugggccuuugacaguggaaaugacauuuggaugggaagaacgauugaaaaggauucgcgcucagguuaugagacuuucagggucauugguggcuggaacacugcuaauuccaagucacagacaaguagacaagucauaguugacagugauaauccgucuggguauucuggcauuuucuccguugaaggcaaaagcugcaucaacagguguuuuuauguagagcugauaagagggagaccaaaggagacuagagugugguggacuucaaauaguaucauuguauuuuguggaacuucagguacuuauggaacaggcucauggccugauggggcaaauauuaauuucaugccuauauaa

SEQ ID NO: 54042 - RNA, 1410 nt, Artificial Sequence
  neuraminidase__InfluenzaA__AGQ81746
augaauccaaaucagaagauaauagcaauugguuccgucucucuaacuauugcgacaauaugccuucucaugcagauugccaucuuaguuacgacuaugacacuacauuucaagcauaaugaaugcuccaacuccucgaauagucaagcaguaccauguggaccaaucauaauagaaaggaacguaacagagauagugcaucuaaauagcacuaccuuagagaaggaaauuuguccuaaagcagcagaauacagggguuggucaaaaccacaaugucaaaucacaggguucgcuccuuucuccaaggacaauucaauuaggcucuccgcaaguggagauauuugggugacaagagaaccuuauguaucgugcgaucuugguaaauguuaucaguuugcacuugggcaggggacuaccuuggacaacagacacucaaacggcacaucacaugauaggacuccucauaggacacuuuuaaugaaugaguuggguguuccguuucauuuggcgaccaaacaagugugcauagcaugguccagcucaagcugucaugauggaaaagcaugguuacauguuuguguuacuggggaugacagaaaugcaacugccaguaucauuuaugaugguauacuuguugacaguauugguucauggucuaaaaacauccucagaacucaggagucagaauguguuugcaucaaugggaccuguacgguaguaaugacggauggaagugcgucaggaaaagcugacacuagaauacuauuuauuagagaggggaaaaucguacacauuagcccuuugucuggaagugcucagcauguggaggaaugcucuuguuacccccaauauccagaaguuagguguguuugcagagacaauuggaggggaucuaauagacccguccuauauauaaacauggcagauuauaguauugauucugguuaugugugcucggggcuuguuggugacacaccaagaaaugacgauauaucuagcagcagcaauugcaaggauccuaauaacgagagaggggccccaggagugaaagggugggccuuugacaguggaaaugaccuuuggaugggaagaacgauugaaaaggauucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagagcugauaagagggagaccaaaggagacuagaguaugguggacuucaaauaguaucauuguguucuguggaacuucagguacuuauggaacaggcucauggccugauggggcgaauaucaauuucaugccuauauaa

SEQ ID NO: 54043 - RNA, 1410 nt, Artificial Sequence
  neuraminidase__InfluenzaA__AGQ81747
augaauccaaaucagaagauaguagcaauugguucugucucucuaacuauugcgacaauaugccuucucaugcagauugccaucuuaguuacgacuaugacacuacacuucaagcauggugaaugcaccaacuccucgaauaaucaagcagugccauguggaccaaucauaauagaaaggaacauaacagagauagugcaucuaaauagcacuaccuuagagaaggaaauuuguccuaaagcagcaggauacagggauuggucaaaaccacaaugucaaaucacaggguucgcuccuuucuccaaggauaauucaauuaggcucuccgcaaguggcgauauuugggugacaagagaaccuuauguaucguguggucuugguaaauguuaucaguuugcacuuggacaggggacuaccuuggacaacagacauucaaacggcacaucacaugauaggacuccucauaggacacuuuuaaugaaugaguuagguguuccguuucauuuggcgaccaaacaagugugcauagcauggucuagcucaagcugucaugaugggaaagcaugguuacauguuugugucacuggggacgauagaaaugcaacugccaguaucauuuaugaugguaugcuuguugacaguauugguucauggucuaaaaacauccucagaacucaggagucagaauguguuugcaucaauggaaccuguacgguaguaaugacagauggaagugcgucaggaaaagcugauacuagaauacuauuuauuagagaggggaaaaucguacacauuagcccuuugucaggaagugcucagcauguggaggaaugcuccuguuacccccaauauccagaaguuagguguguuugcagagacaauuggaggggaucuaaucgacccguucuauauauaaauauggcggauuauaguguugauuccgguuaugugugcucgggacuuguuggugacacaccuagaaaugacgauacaucuagcagcagcaauugcaaggauccuaauaaugagagaggggccccaggagugaaagggugggccuuugacaguggaaaugacauuuggaugggaagaacgauugaaaaggauuugcgcucagguuaugagacuuucagggucauuggugguuggaacacugcuaauuccaagucacagacaaguagacaagucauaguugacagugacaauucgucuggguauucuggcauuuucuccguugaaggcaaaagcugcaucaacagguguuuuuauguagaguugauaagagggagaccaaaggagacuagagugugguggacuucaaauaguaucauuguauucuguggaacuucagguacuuauggaacaggcucauggccugauggggcaaauaucaauuucaugccuauauaa

SEQ ID NO: 54044 - RNA, 1401 nt, Artificial Sequence
  neuraminidase__InfluenzaA__AGQ81749
augaauccaaaucagaagauaauagcaauuggcucgguuucucuaaccacugcgauaauauguuuucucaugcagauugccaucuuaacaacgaccaugacacuacauuucaagcagaaugaaugcagcaacccaucaaauaaucaaguggugccaugugaaccgaucauaauagagaggaacacagugcauuugaauaguacuaccauagagaaggaaauuuguucuaaaguagcagaauacaagaauuggucaaaaccacaaugucaaauuacaggguucgcuccuuucucaaaggacaacucaauuaggcuuucugcagguggggauaucugggugacaagagaaccuuauguaucaugcagucuuggcaaauguuaucaauuugcacuugggcagggaaccacccugaaaaacaagcacucaaauggcacuacacaugauagaauuccucacagaacucuuuuaaugaaugaguuaggugucccauuucauuugggaaccaaacaagugugcauagcauggucuaguucaagcugcuaugaugggaaggcaugguuacauauuuguguuacuggggaugauaaaaaugcuacugcuaguaucauuuaugaugggaugcuugcugacaguauugguucaugguccaaaaacauccucagaacucaggagucagaaugcguuugcaucaauggaacuugugcaguaguaaugacugauggaagugcaucaggaaaggcugacacuagaauauuauucauaagagaggggagaauuauaaauauuagcccauugucaggaagcgcucagcacguugaggaauguuccuguuacccccgguauccugaaguuagguguguuugcagagacaauuggaagggcuccaauaggcccguucuauauauaaauauggcagauuauaguguugaguccaguuaugugugcucaggacuuguaggcgacacaccaagaaaugaugauagcuccagcagcagcaacugcagagacccuaauaacgagagaggggccccaggagugaaagggugggccuuugacgaugggaaugauguuuggaugggacgaacaaucaaaaaagauucacgcucagguuaugagacuuuuagggucaucaaugguuggaccacggccaauuccaagucacagauaaauaggcaaguuauaguugacagugacaacuggucuggguauucugguaucuuuucaguugaagguaaaaacugcaucaacagauguuuuuauguggaauugauaagaggaagaccacaggagcccaaagugugguggacuucaaauagcaucauugcauucuguggaaccucagguaccuauggaacaggcucauggccugauggagcgaauaucaacuucaugccuauauaa

SEQ ID NO: 54045 - RNA, 1401 nt, Artificial Sequence
  neuraminidase__InfluenzaA__AGQ81750
augaauccaaaucagaagauaauagcaauuggcucgguuucucuaaccacugcgauaauauguuuucucaugcagauugccaucuuaacaacgaccaugacacuacauuucaagcagaaugaaugcagcaacccaucaaauaaucaaguggugccaugugaaccgaucauaauagagaggaacacagugcauuugaauaguacuaccauagagaaggaaauuuguucuaaaguagcagaauacaagaauuggucaaaaccacaaugucaaauuacaggguucgcuccuuucucaaaggacaacucaauuaggcuuucugcagguggggauaucugggugacaagagaaccuuauguaucaugcagucuuggcaaauguuaucaauuugcacuugggcagggaaccacccugaaaaacaagcacucaaauggcacuacacaugauagaauuccucacagaacucuuuuaaugaaugaguuaggugucccauuucauuugggaaccaaacaagugugcauagcauggucuaguucaagcugcuaugaugggaaggcaugguuacauauuuguguuacuggggaugauaaaaaugcuacugcuaguaucauuuaugaugggaugcuugcugacaguauugguucaugguccaaaaacauccucagaacucaggagucagaaugcguuugcaucaauggaacuugugcaguaguaaugacugauggaagugcaucaggaaaggcugacacuagaauauuauucauaagagaggggagaauuauaaauauuagcccauugucaggaagcgcucagcacguugaggaauguuccuguuacccccgguauccugaaguuagguguguuugcagagacaauuggaagggcuccaauaggcccguucuauauauaaauauggcagauuauaguguugaguccaguuaugugugcucaggacuuguaggcgacacaccaagaaaugaugauagcuccagcagcagcaacugcagagacccuaauaacgagagaggggccccaggagugaaagggugggccuuugacgaugggaaugauguuuggaugggacgaacaaucaaaaaagauucacgcucagguuaugagacuuuuagggucaucaaugguuggaccacggccaacuccaagucacagauaaauaggcaaguuauaguugacagugacaacuggucuggguauucugguaucuuuucaguugaagguaaaaacugcaucaacagauguuuuuauguggaauugauaagaggaagaccacaggagcccaaagugugguggacuucaaauagcaucauugcauucuguggaaccucagguacauauggaacaggcucauggccugauggagcgaauaucaacuucaugccuauauaa

SEQ ID NO: 54046 - RNA, 1410 nt, Artificial Sequence
  neuraminidase__InfluenzaA__AGQ81751
augaauccaaaucagaagauaauagcaauugguucugucucucuaacuauugcgacaauaugccuucucaugcagauugccaucuuaguuacgacuaugacacuauauuucaagcauaaugaaugcuccaacuccucgaauaaucaagcaguaccauguggaccaaucauaauagaaaggaacauaacagagauagugcaucuaaauagcacuaccuuagagaaggaaauuuguccuaaagcagcaggauacagggauuggucaaaaccacaaugucaaaucacaggguucgcuccuuucuccaaggacaauucaauuaggcucuccgcaaguggagauauuugggugacaagagaaccuuauguaucgugcggucuugguaaauguuaucaguuugcacuugggcaggggacuaccuuggacaacagacacucaaacggcacaucacaugauaggacuccucauaggacacuuuuaaugaaugaauuggguguuccguuucauuuggcgaccaaacaagugugcauagcuugguccagcucaagcugucaugaugggaaagcaugguuacauguuuguguuacuggggaugacagaaaugcaacugccaguaucauuuaugaugguauacuuguugacaguauugguucauggucuaaaaauauccucagaacucaggagucagaauguguuugcaucaaugggacuuguacgguaguaaugacagauggaagugcgucaggaaaagcugacacuagaauacuauuuauuagagaggggaaaaucguacacauuagcccuuugucaggaagugcucagcauguggaggaaugcuccuguuacccccaauauccagaagucagguguguuugcagagacaauuggaggggaucuaauagaccaguucuauauauaaauauggcagauuauaguauugauucugguuaugugugcucgggacuuguuggugacacaccaagaaaugacgauauaucuaguagcagcaauugcaaggauccuaauaacgagagaggugccccaggagugaaagggugggccuuugacaguggaaaugaccuuuggaugggaagaacgauugaaaaggaaucgcgcucagguuaugagacuuucagggucauuggugguuggaacacugcuaauuccaagucacagacaaguagacaagucauaguugacagugauaauucgucuggguauucuggcauuuucuccguugaaggcaaaagcugcaucaacagguguuuuuauguagaguugauaagagggagaccaaaggagacuagaguaugguggacuucaaauaguaucauuguauucuguggaacuucagguacuuauggaacaggcucauggccugauggggcgaauaucaauuucaugccuauauaa

SEQ ID NO: 54047 - RNA, 1410 nt, Artificial Sequence
  neuraminidase__InfluenzaA__AGQ81753
augaauccaaaucagaagauaguagcaauugguucugucucucuaacuauugcgacaauaugccuucugaugcagauugccaucuuaguuacgacuaugacacuacacuucaagcauggugaaugcaccaacuccucgaauaaucaagcagugccauguggaccaaucauaauagaaaggaacauaacagggauagugcaucuaaauagcacuaccuuagagaaggaaauuuguccuaaagcagcaggauacagggauuggucaaaaccacagugucaaaucacaggguucgcuccuuucuccaaggauaauucaauuaggcucuccgcaaguggcgauauuugggugacaagagaaccuuauguaucgugcggucuugguaaauguuaucaguuugcacuuggacaggggacuaccuuggacaacagacauucaaacggcacaucacaugauaggacuccucauaggacacuuuuaaugaaugaguuagguguuccguuucauuuggcgaccaaacaagugugcauagcauggucuagcucaagcugucaugaugggaaagcaugguuacauauuugugucacuggggaugauagaaaugcaacugccaguaucauuuaugaugguaugcuuguugacaguauugguucauggucuaaaaacauucucagaacucaggagucagaauguguuugcaucaauggaaccugcacgguaguaaugacagauggaagugcgucaggaaaagcugauacuagaauacuauuuauuagagaggggaaaaucguacacauuagcccuuugucaggaagugcucagcauguggaggaaugcuccuguuacccccaauauccagaaguuagauguguuugcagagacaauuggaggggaucuaaucgacccguucuauauauaaauauggcggauuauaguguugauuccgguuaugugugcucgggacuuguuggugacacaccuagaaaugacgauacaucuagcagcagcaauugcaaggauccuaacaaugagagaggggccccaggagugaaagggugggccuuugacaguggaaaugacauuuggaugggaagaacgauugaaaaggauuugcgcucagguuaugagacuuucagggucauuggugguuggaacacugcuaauuccaagucacagacaaauagacaagucauaguugacagugacaauucgucuggguauucuggcauuuucuccguugaaggcaaaagcugcaucaacagguguuuuuauguagaguugauaagagggagaccaaaggagacuagagugugguggacuucaaauaguaucauuguauucuguggaacuucagguacuuauggaacaggcucauggccugauggggcaaauauaaauuucaugccuauauaa

SEQ ID NO: 54048 - RNA, 1410 nt, Artificial Sequence; identical to SEQ ID NO: 54047
  neuraminidase__InfluenzaA__AGQ81754

SEQ ID NO: 54049 - RNA, 1410 nt, Artificial Sequence
  neuraminidase__InfluenzaA__AGQ81756
augaauccaaaucagaagauaauagcaauugguuccaucucucuaacuauugccacaauaugccuucucauacagauugccaucuuaguuacgacuaugacacuacauuucaagcauggugaaugcaccaacuccucgaacaaucaagcagugccauguggaccaaucauaauagaaaggaacguaacagagauagugcaucuaaauagcacuaccuuagagaaggaaauuugucccaaagcagcaggauacagggauuggucaaaaccacaaugucaaaucacaggguucgcuccuuucuccaaggacaauucaauuaggcucuccgcaaguggcgacauuugggugacaagagaaccuuauguaucgugcggucuugguaaauguuaucaguuugcacuuggacaggggaccacccuggacaacagacauucaaacggcacaucacaugauaggacuccucauaggacacuuuuaaugaaugaguuggguguuccauuucauuuggcgaccaaacaagugugcauagcauggucuagcucaagcugucaugaugggaaagcauggcuacauguuugugucacuggggaugauagaaaugcaacugccagcaucauuuaugauggucugcuuguugacaguauugguucauggucuaaaaacauccucagaacucaggagucagaauguguuugcaucaauggaaccuguacgguaguaaugacggauggaagugcgucaggaaaagcugauacuagaauacuauuuauuagagaggggaaaaucauacacauuagcccuuugucaggaagugcucagcauguggaggaaugcuccuguuacccccaauauccagaaguuagguguguuugcagagacaauuggaggggaucuaauagacccguucuauauauaaauauggcagauuauaguguugauuccgguuaugugugcucgggacuuguuggugacacaccaagaaaugacgauacaucuagcagcagcaauugcaaggauccuaacaaugagagaggggccccaggagugaaagggugggccuuugacaguggaaaugacauuuggaugggaagaacgauugaaaaggauucgcgcucagguuaugagacuuucagggucauuggugguuggaacacugcuaacuccaagucacagacuaguagacaagucauaguugacagugauaauucgucuggguauucuggcauuuuuuccguugaaggcaaaagcugcaucaacagguguuuuuauguagagcugauaagagggagaccaaaggagacuagagugugguggacuucaaauaguaucauuguauucuguggaacuucagguaccuauggaacaggcucauggccugauggggcaaauaucaauuucaugccuauauaa

SEQ ID NO: 54050 - RNA, 1410 nt, Artificial Sequence
  neuraminidase__InfluenzaA__AGQ81757
augaauccaaaucagaagauaauagcaauugguuccgucucucuaacuauugccacaauaugccuucucauacagauugccaucuuaguuacgacuaugacacuacauuucaagcauggugaaugcaccaacuccucgaacaaucaagcagugccauguggaccaaucauaauagaaaggaacguaacagagauagugcaucuaaauagcacuaccuuagagaaggaaauuugucccaaagcagcaggauacagggauuggucaaaaccacaaugucaaaucacaggguucgcuccuuucuccaaggacaauucaauuaggcucuccgcaaguggcgacauuugggugacaagagaaccuuauguaucgugcggucuugguaaauguuaucaguuugcacuuggacaggggaccacccuggacaacagacauucaaacggcacaucacaugauaggacuccucauaggacacuuuuaaugaaugaguuggguguuccauuucauuuggcgaccaaacaagugugcauagcauggucuagcucaagcugucaugaugggaaagcauggcuacauguuugugucacuggggaugauagaaaugcaacugccagcaucauuuaugauggucugcuuguugacaguauugguucauggucuaaaaacauccucagaacucaggagucagaauguguuugcaucaauggaaccuguacgguaguaaugacggauggaagugcgucaggaaaagcugauacuagaauacuauuuauuagagaggggaaaaucauacacauuagcccuuugucaggaagugcucagcauguggaggaaugcuccuguuacccccaauauccagaaguuagguguguuugcagagacaauuggaggggaucuaauagacccguucuauauauaaauauggcagauuauaguguugauuccgguuaugugugcucgggacuuguuggugacacaccaagaaaugacgauacaucuagcagcagcaauugcaaggauccuaacaaugagagaggggccccaggagugaaagggugggccuuugacaguggaaaugacauuuggaugggaagaacgauugaaaaggauucgcgcucagguuaugagacuuucagggucauuggugguuggaacacugcuaacuccaagucacagacuaguagacaagucauaguugacagugauaauucgucuggguauucuggcauuuuuuccguugaaggcaaaagcugcaucaacagguguuuuuauguagagcugauaagagggagaccaaaggagacuagagugugguggacuucaaauaguaucauuguauucuguggaacuucagguaccuauggaacaggcucauggccugauggggcaaauaucaauuucaugccuauauaa

SEQ ID NO: 54051 - RNA, 1401 nt, Artificial Sequence
  neuraminidase__InfluenzaA__AGQ81758
augaauccaaaucagaagauaauagcaauuggcucuguuucucuaaucauugcgauaauaugucuccucaugcagauugccaucuuaacaacgacuaugacacuacauuucaggcagaaugaaugcaguaacccaucgaauaaucaaguggugccaugugaaccgaccauaauagagaggaacacagugcauuugaauaguacuaccauagagagggaaauuuguccuaaaguagcagaauacaagaauuggucaaaaccacaaugucaaauuacaggguucgcuccuuucucaaaggacaacucaauuaggcuuucugcagguggggauaucugggugacaagagaaccuuauguuucaugcagucucggcaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugaugaaaaugcuacugcuaguaucaucuaugaugggaugcuuguugacaguauugguucaugguccaaaaacauccucagaacucaggagucagaaugcguuugcaucaauggaacuugugcagugguaaugacugaugguagugcaucaggaaaggcugacacuagaguauuauucauaagagaagggaaaauuauaaauauuagcccauugucaggaagugcucagcacguugaggaaugcuccuguuauccccgguauccugaaguuagguguguuugcagagacaauuggaagggcuccaauaggccuguucuauauauaaauauggcggauuauaguauugaguccaguuaugugugcucaggacuuguuggcgacacaccaagaaaugaugauagcuccagcagcagcaauugcagagacccuaauaacgaaagaggggccccaggagugaaagggugggccuuugacgacgggaaugauguuuggaugggacggacaaucaaaaaugauucacgcucagguuaugagacuuuuagggucgucaaugguuggaccauggcuaauucaaagucacagauaaauaggcaagucauaguugacagugacaacuggucuggguauucuggcaucuucucuguugaaggcaaaaaaugcaucaacagguguuuuuauguggaguugauaagagggagaccacaggaacccagagugugguggacuucaaauagcaucauuguauucuguggaaccucagguacauauggaacaggcucauggccugauggagcgaauaucaacuucaugccuauauaa

SEQ ID NO: 54052 - RNA, 1401 nt, Artificial Sequence
  neuraminidase__InfluenzaA__AGQ81759
augaauccaaaucagaagauaauagcaauuggcucuguuucucuaaccauugcgauaauauguuuucucauacagauugccaucuuaacaacgaccaugacacuacauuucaggcagagugaaugcagcaacccaucgaauaaucaaguggugccaugugaaccuaucauaauagaaaggaacacagugcauuugaauaguacuaucauagagaaggaaauuuguccuaaaguggcagaauacaagaauuggucaaaaccacaaugucaaauuacaggguucgcuccuuucucaaaggacaacucaauuaggcuuucugcagguggagauaucugggugacaagagaaccuuaugugucgugcagucuuggcaaauguuaucaauuugcacuugggcagggaaccacucugaaaaacaagcauucaaauggcacuacacaugauagaauuccucacagaacucuuuuaaugaaugaguuaggugucccauuucauuugggaaccaaacaagugugcauagcauggucuaguucaagcugccaugaugggaaagcaugguuacauauuugugugacuggggaugauaaaaaugcuacugcuaguauaauuuaugaugggaugcugguugacaguauugguucaugguccaaaaacauccuaagaacccaggagucagaaugcguuugcaucaauggaacuugugcaguaguaaugacugauggaagugcaucaggaaaggcugacacuagaauacuauucauaagagagggaaaaauuauaaauauuagcccauugucaggaagugcucagcauguggaggaaugcuccuguuacccccgguauccugaaguuagguguguuugcagagacaauuggaagggcuccaacaggcccguucuauauauaaauauggcagauuauagcauugaguccaguuauguaugcucaggacuuguuggcgacacaccaagagaugaugauagcuccagcagcagcaacuguagagacccuaauaacgaaagaggggccccaggagugaaagggugggccuuugacgaugggaaugacauuuggaugggacgaacaaucaaaagugauucacgcucagguuaugagacuuuuagggucauuaaugguuggaccacggcuaauuccaagucacagauaaauaggcaagucauaguugacagugacaguuggucuggguauucugguaucuucucuguugaaggcaaaaacugcaucaacagguguuuuuauguggaguugauaagagggagaccacgggagaccagaguaugguggacuucaaacagcaucauuguauucuguggaaccucagguacauauggaacaggcucauggccugauggagcgaauaucaacuucaugccuauauaa

SEQ ID NO: 54053 - RNA, 1401 nt, Artificial Sequence
  neuraminidase__InfluenzaA__AGQ81760
augaauccaaaucagaagauaauagcaauuggcucuguuucucuaaccauugcgauaauauguuuucucaugcagauugccaucuuaacaacgaccaugacacuacauuucaggcagaaugaaugcagcaauccaucgaauaaucaaguggugccaugugaaccuaucauaauagagaggaacacagugcauuugaauaguacuaccauagagaaggaaauuuguccuaaaguggcagaauacaagaauuggucaaaaccacaaugucaaauuacaggguuugcuccuuucucaaaggacaacucaauuaggcuuucugcagguggagauaucugggugacaagagaaccuuaugugucgugcagucuuggaaaauguuaucaguuugcacuugggcagggaaccacucugaaaaacaagcacucaaauggcacuacacacgauagaauuccucacagaacucuuuuaaugaaugaguuaggugucccauuucauuugggaaccaaacaagugugcauagcauggucuaguucaagcugccaugaugggaaagcaugguuacauauuugugugacuggggaugauaaaaaugcuacugcuaguaucauuuaugaugggaugcugguugacaguauugguucaugguccaaaaacauccuaagaacccaggagucagaaugcguuugcaucaauggaacuugugcaguaguaaugacugauggaagugcaucaggaaaggcugacacuagaguauuauucauaagagagggaaaaauuauaaauauuagcccauugucaggaagugcucagcacguggaggaaugcuccuguuacccccgguauccugaaguuagguguguuugcagagacaauuggaagggcuccaauaggcccguucuauauauaaauauggcagauuauaguauugaguccaguuauguaugcucaggacuuguuggcgacacaccaagagaugaugauagcuccaguagcagcaacuguagagacccuaauaacgaaagaggggccccaggaguaaaagggugggccuuugacgaugggaaugacauuuggaugggacgaacaaucaaaagugauucacgcucagguuaugagacuuuuagggucguuaaugguuggaucacagcuaauuccaagucacagauaaauaggcaagucauaguugacagugacagcuggucuggguauucugguaucuucucuguugaaggcaaaaacugcaucaacagguguuuuuauguggaguugauaagagggagaccacaggagaccagagugugguggacuucaaacagcaucauuguauucuguggaaccucggguacauauggaacaggcucauggccugauggagcgaauaucaacuucaugccuauauaa

SEQ ID NO: 54054 - RNA, 1401 nt, Artificial Sequence
  neuraminidase__InfluenzaA__AGQ81761
augaauccaaaucagaagauaauagcaauuggcucuguuucucuaaccauugcgauaauauguuuucucaugcagauugccaucuuaacaacgaccaugacacugcauuucaggcagaaugaaugcagcaauccaucgaauaaucaaguggugccaugugaaccuaucauaauagagaggaacacagugcauuugaauaguacuaccauagagaaggaaauuuguccuaaaguggcagaauacaagaauuggucaaaaccacaaugucaaauuacaggguucgccccuuucucaaaggacaacucaauuaggcuuucugcagguggagauaucugggugacaagagaaccuuaugugucgugcagucuuggcaaauguuaucaauuugcacuugggcagggaaccacucugaaaaacaagcacucaaauggcacuacacaugauagaauuccucacagaacucuuuuaaugaaugaguuaggugucccauuucauuugggaaccaaacaagugugcauagcauggucuaguucaagcugccaugaugggaaagcaugguuacauauuugugugacuggggaugauaaaaaugcuacugcuaguaucauuuaugaugggaugcugguugacaguauugguucaugguccaaaaacauccuaagaacccaggagucagaaugcguuugcaucaauggaacuugugcaguaguaaugacugauggaagugcaucaggaaaggcugacacuagaauauuauucauaaaagagggaaaaauuauaaauauuagcccauugucaggaagugcucagcacguggaggaaugcuccuguuacccccgguauccugaaguuagguguguuugcagagacaauuggaagggcuccaauaggcccguucuauauauaaauauggcagauuauaguauugaguccaguuauguaugcucaggacuuguuggcgacacaccaagagaugaugauagcuccagcagcagcaacuguagagacccuaauaacgaaagaggggccccaggagugaaagggugggccuuugacgaugggaaugacauuuggaugggacgaacaaucaaaagugauucacgcucagguuaugagacuuuuagggucguuaaugguuggaccacggccaauuccaagucacagauaaauaggcaagucauaguugacagugacagcuggucuggguauucugguaucuucucuguugaaggcaaaaacuguaucaacagguguuuuuauguggaguugauaagagggagaccacaggagaccagagugugguggacuucaaacagcaucauuguauucuguggaaccucagguacauauggaacaggcucauggccugauggagcgaauaucaacuucaugccuauauaa

SEQ ID NO: 54055 - RNA, 1401 nt, Artificial Sequence
  neuraminidase__InfluenzaA__AGQ81763
augaauccaaaucagaagauaauagcaauuggcucuguuucucuaaucauugcgauaauaugucuccucaugcagauugccaucuuaacaacgacuaugacacuacauuucaggcagaaugaaugcaguaacccaucgaauaaucaaguggugccaugugaaccgaucauaauagagaggaacacagugcauuugaauaguacuaccauagagagggaaauuuguccuaaaguagcagaauacaagaauuggucaaaaccacaaugucaaauuacaggguucgcuccuuucucaaaggacaacucaauuaggcuuucugcagguggggauaucugggugacaagagaaccuuauguuucaugcagucucggcaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuugugucacuggggaugauaaaaaugcuacugcuaguaucaucuaugaugggaugcuuguugacaguauugguucaugguccaaaaacauccucaggacucaggagucagaaugcguuugcaucaauggaacuugugcagugguaaugacugauggaagugcaucaggaaaggccgacacuagaguauuauucauaagagaagggaaaauuauaaauauuagcccauugucaggaagugcucagcacguugaggaaugcuccuguuacccccgguauccugaaguuagguguguuugcagagacaauuggaagggcuccaauaggcccguucuauauauaaauauggcggauuauaguauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggaaggacaaucaaaaaugguucacgcucagguuaugagacuuuuagggucgucaaugguuggaccauggcuaauucaaagucacagauaaauaggcaagucauaguugacagugacaacuggucuggguauucuggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54056 - RNA, 1401 nt, Artificial Sequence
  neuraminidase__InfluenzaA__AGQ81766
augaauccaaaucagaagauaauagcaauuggcucuguuucucuaaccauugcgauaauauguuuucucaugcagauugccaucuuaacaacgaccaugacacugcauuucaggcagaaugaaugcagcaauccaucgaauaaucaaguggugccaugugaaccuaucauaauagagaggaacacagugcauuugaauaguacuaccauagagaaggaaauuuguccuaaaguggcagaauacaagaauuggucaaaaccacaaugucaaauuacaggguucgcuccuuucucaaaggacaacucaauuaggcuuucugcagguggagauaucugggugacaagagaaccuuaugugucgugcagucuuggcaaauguuaucaauuugcacuugggcagggaaccacucugaaaaacaagcacucaaauggcacuacacaugauagaauuccucacagaacucuuuuaaugaaugaguuaggugucccauuucauuugggaaccaaacaagugugcauagcauggucuaguucaagcugucaugaugggaaagcaugguuacauauuugugugacuggggaugauaaaaaugcuacugcuaguaucauuuaugaugggaugcugguugacaguauugguucaugguccaaaaacauccuaagaacccaggagucagaaugcguuugcaucaauggaacuugugcaguaguaaugacugauggaagugcaucaggaaaggcugacacuagaauauuauucauaagagagggaaaaauuauaaauauuaguccauugucaggaagugcucagcacguggaggaaugcuccuguuacccccgguauccugaaguuagguguguuugcagagacaauuggaagggcuccaauaggcccguucuauauauaaauauggcagauuauaguauugaguccaguuaugugugcucaggacuuguuggcgacacaccaagagaugaugauagcuucagcagcagcaacuguagagacccuaauaacgaaagaggggccccaggagugaaagggugggccuuugacgaugggaaugacauuuggaugggacgaacaaucaaaagugauucacgcucagguuaugagacuuuuagggucguuaaugguuggaccacggcuaauuccaagucacagauaaauaggcaagucauaguugacagugacagcuggucuggguauucugguaucuucucuguugaaggcaaaaacugcaucaacagguguuuuuauguggaguugauaagagggagaccacaggagaccauagugugguggacuucaaacagcaucauuguauucuguggaaccucagguacauauggaacaggcucauggccugauggagcgaauaucaacuucaugccuauauaa

SEQ ID NO: 54057 - RNA, 1401 nt, Artificial Sequence; identical to SEQ ID NO: 54056
  neuraminidase__InfluenzaA__AGQ81767

SEQ ID NO: 54058 - RNA, 1410 nt, Artificial Sequence
  neuraminidase__InfluenzaA__AGQ81768
augaauccaaaucagaagauaguagcaaucgguucugucucucuaacuauugcgacaauaugccuucucaugcagauugccaucuuaguuacgacuaugacauuacacuucaagcauggugaaugcaccaacuccucgaauaaucaagcagugccauguggaccaaucauaauagaaaggaacauaacagagauagugcaucuaaauagcacuaccuuagagaaggaaauuuguccuaaagcagcaggauacagggauuggucaaaaccacagugucaaaucacaggguucgcuccuuucuccaaggauaauucaauuaggcucuccgcaaguggcgauauuugggugacaagagaaccuuauguaucaugcggucuugguaaauguuaucaguuugcacuuggacaggggacuaccuuggacaacagacauucaaacggcacaucacaugauaggacuccucauaggacacuuuuaaugagugaguuagguguuccguuucauuuggcgaccaaacaagugugcauagcauggucuagcucaagcugucaugauggggaagcaugguuacauauuugugucacuggggaugauagaaaugcaacugccaguaucauuuaugaugguaugcuuguugacaguauuggcucauggucuaaaaacauucucagaacucaggagucagaauguguuugcaucaauggaaccugcacgguaguaaugacagauggaagugcgucaggaaaagcugauacuagaauacuauuuauuagagaggggaaaaucgugcacauuagcccuuugucaggaagugcucagcauguggaggaaugcuccuguuacccccaauauccagaaguuagauguguuugcagagacaauuggaggggaucuaaucgacccguucuauauauaaauauggcggauuauaguguugauucugguuaugugugcucgggacuuguuggugacacaccuagaaaugacgauacaucuagcagcagcaauugcaaggauccuaacaaugagagaggggccccaggagugaaagggugggccuuugacaguggaaaugacauuuggaugggaagaacgauugaaaaggauuugcgcucagguuaugagacuuucagagucauuggugguuggaacaccgcuaauuccaagucacagacaaauagacaagucauaguugacagugacaauucaucuggguauucuggcauuuucuccguugaaggcaaaagcugcaucaacagguguuuuuauguagaguugauaagagggagaccaaaggagacuagagugugguggacuucaaauaguaucauuguauucuguggaacuucagguacuuauggaacaggcucauggccugauggggcaaauauaaauuucaugccuauauaa

SEQ ID NO: 54059 - RNA, 1410 nt, Artificial Sequence
  neuraminidase__InfluenzaA__AGQ81769
augaauccaaaucagaagauaguagcaaucgguucugucucucuaacuauugcgacaauaugccuucucaugcagauugccaucuuaguuacgacuaugacauuacacuucaagcauggugaaugcaccaacuccucgaauaaucaagcagugccauguggaccaaucauaauagaaaggaacauaacagagauagugcaucuaaauagcacuaccuuagagaaggaaauuuguccuaaagcagcaggauacagggauuggucaaaaccacagugucaaaucacaggguucgcuccuuucuccaaggauaauucaauuaggcucuccgcaaguggcgauauuugggugacaagagaaccuuauguaucaugcggucuugguaaauguuaucaguuugcacuuggacaggggacuaccuuggacaacagacauucaaacggcacaucacaugauaggacuccucauaggacacuuuuaaugagugaguuagguguuccguuucauuuggcgaccaaacaagugugcauagcauggucuagcucaagcugucaugauggggaagcaugguuacauauuugugucacuggggaugauagaaaugcaacugccaguaucauuuauggugguaugcuuguugacaguauuggcucauggucuaaaaacauucucagaacucaggagucagaauguguuugcaucaauggaaccugcacgguaguaaugacagauggaagugcgucaggaaaagcugauacuagaauacuauuuauuagagaggggaaaaucgugcacauuagcccuuugucaggaagugcucagcauguggaggaaugcuccuguuacccccaauauccagaaguuagauguguuugcagagacaauuggaggggaucuaaucgacccguucuauauauaaauauggcggauuauaguguugauucugguuaugugugcucgggacuuguuggugacacaccuagaaaugacgauacaucuagcagcagcaauugcaaggauccuaacaaugagagaggggccccaggagugaaagggugggccuuugacaguggaaaugacauuuggaugggaagaacgauugaaaaggauuugcgcucagguuaugagacuuucagagucauuggugguuggaacacugcuaauuccaagucacagacaaauagacaagucauaguugacagugacaauucaucuggguauucuggcauuuucuccguugaaggcaaaagcugcaucaacagguguuuuuauguagaguugauaagagggagaccaaaggagacuagagugugguggacuucaaauaguaucauuguauucuguggaacuucagguacuuauggaacaggcucauggccugauggggcaaauauaaauuucaugccuauauaa

SEQ ID NO: 54060 - RNA, 1401 nt, Artificial Sequence
  neuraminidase__InfluenzaA__AGQ81770
augaauccaaaucagaagauaauagcaauuggcucuguuucuauaaccauugcgauaauauguuuuaucaugcagauugccaucuuaacaacgaccaugacacuacauuucaggcagaaugaaugcagcaauccaucgaauaaucaaguggugccaugugaaccuaucauaauagagaggaacacagugcauuugaauaguacuaccauagagaaggaaacuuguccuaaaguggcagaauacaagaauuggucaaaaccacaaugucaaauuacaggguuugcuccuuucucaaaggacaacucaauuaggcuuucugcagguggagauaucugggugacaagagaaccuuaugugucgugcagucuuggaaaauguuaucaguuugcacuugggcagggaaccacucugaaaaacaagcacucaaauggcacuacacacgauagaauuccucacagaacucuuuuaaugaaugaguuaggugucccauuucauuugggaaccaaacaagugugcauagcauggucuaguucaagcugccaugaugggaaagcaugguuacauauuugugugacuggggaugauaaaaaugcuacugcuaguaucauuuaugaugggaugcugguugacaguauugguucaugguccaaaaacauccuaagaacccaggagucagaaugcguuugcaucaauggaacuugugcaguaguaaugacugauggaagugcaucaggaaaggcugacacuagaguauuauucauaagagagggaaaaauuauaaauauuagcccauugucaggaagugcucagcacguggaggaaugcuccuguuacccccgguauccugaaguuagguguguuugcagagacaauuggaagggcuccaauaggcccguucuauauauaaauauggcagauuauaguguugaguccaguuauguaugcucaggacuuguuggcgacacaccaagagaugaugauagcuccaguagcagcaacuguagagacccuaauaacgaaagaggggccccaggaguaaaagggugggccuuugacgaugggaaugacauuuggaugggacgaacaaucaaaagugauucacgcucagguuaugagacuuuuagggucguuaaugguuggaccacagcuaauuccaagucacagauaaauaggcaagucauaguugacagugacagcuggucuggguauucugguaucuucucuguugaaggcaaaaacugcaucaacagguguuuuuauguggaguugauaagagggagaccacaggagaccagagugugguggacuucaaacagcaucauaguauucuguggaaccucagguacauauggaacaggcucauggccugauggagcgaauaucaacuucaugccuauauaa

SEQ ID NO: 54061 - RNA, 1410 nt, Artificial Sequence
  neuraminidase__InfluenzaA__AGQ81772
augaauccaaaucagaagauaguagcaauuggcuccgccucccuaacuauugcgacaaugugccuccuccugcagauugcccucuuugcuacaacuaugacacuacauuucaagcagacggggugcacaaacuccucugacaaucaagcagugccauguggaccaaucauaauagaaaggaacauaacagaaauagugcauuugaauagcaccacuuuagaaaaggaaacuuguccuaagucagcaggauacaggaauuggucuaaaccacaaugucaaaucacaggauucgcuccuuucuccaaggacaauucaauuaggcuugccgcagcuggagauauuugggugacaagagaaccuuaugugucaugcggucuugguaaauguuaucaauuugcucuugggcaggggaccaccuuggacaacaaacacucaaauggcacaacacaugauagaacuccucauagaacccuuuuaaugagugaguuggguguuccguuucauuuggcaaccaaacaaguguguauagcaugguccagcucaagcugccaugauggaaaagcaugguuacauguuugugucacaggggacgauaagaaugcaacugcuaguaucauuuaugaugggauacuuguugacagcauugcuucauggucuaaaaacauacucagaacucaagagucagaaugcguuuguauuaacggaaccuguacgguaguaaugacagauggaagugcaucaggaagggcugacaccagaauacuauuuauuagagaggggaaaaucguacacauuagcccauugucaggaagugcucagcauguugaggaaugcuccuguuacccccgauauccagaaguuagauguguuugcagagacaauuggaagggauccaauagacccguucuauuuauaaauauggcagauuauaguauugauuccaguuauguguguccagggcuugugggcgacacaccaagaaaugaugauagaucuagcagcagcaacugcagagauccuaauaacgaaagaggagccccaggagugaaagggugggccuucgacaguggaaaugauauuuggaugggaagaacgaucgaaaaggauucgcgcucagguuaugagacuuucagggucauuagugguuggagcacagcuaauuccaagucacagauaaauagacaagucauaguugaucgugauaacucgucuggguauucugguauuuucucuguugaaggcaaaagcugcaucaacagguguuuuuauguagagcugauaagaggaagaccaaaagagaauagagugugguggacuucaaacagcaucauuguauuuuguggaacuucagguacuuauggaacaggcucauggccugauggggcgaauaucaaucucaugccgauauaa

SEQ ID NO: 54062 - RNA, 1401 nt, Artificial Sequence
  neuraminidase__InfluenzaA__AGQ81773
augaauccaaaucagaagauaauagcaauuggcucuguuucucuaaccauugcgauaauauguuuucucaugcagauugccaucuuaacaacgaccaugacacuacauuucaggcagaaugaaugcagcaauccaucgaauaaucaaguggugccaugugaaccuaucauaauagagaggaaaacagugcauuugaauaguacuaccauagagaaggaaauuuguccuaaaguggcagaauacaagaauuggucgaaaccacaaugucaaauuacaggguuugcuccuuucucaaaggacaacucaauuaggcuuucugcagguggagauaucugggugacaagagaaccuuaugugucgugcagucuuggaaaauguuaucaguuugcacuugggcagggaaccacucugaaaaacaagcacucaaauggcaccacacacgauagaauuccucacagaacucuuuuaaugaaugaguuaggugucccauugcauuggggaaccaaacaagugugcauagcauggucuaguucaagcugccaugaugggaaagcaugguuacauauuuguguaacuggggaugauaaaaaugcuacugcuaguaucauuuaugaugggaugcugguugacaguauugguucaugguccaaaaacauccuaagaacccaggagucagaaugcguuugcaucaauggaacuugugcaguaguaaugacugaugggagugcaucaggaaaggcugauacuagaguauuauucauaagagagggaaaaauuauaaauauuagcccauugucaggaagugcucagcacguggaggaaugcucauguuacccccgguauccugaaguuagguguguuugcagagacaauuggaagggcuccaauaggcccguucuauauauaaauauggcagauuauaguauugaguccaguuauguaugcucaggacuuguuggcgacacaccaagagaugaugauagcuccaguagcagcaacuguagagacccuaauaacgaaagaggggccccaggaguaaaaggguggggcuuugacgaugggaaugacauuuggaugggacgaacaaucaaaagugauucacgcucagguuaugagacuuuuagggucguuaaugguuggaccacagcuaauuccaagucacagauaaauaggcaagucauaguugacagugacagcuggucuggguauucugguaucuucucuguugaaggcaaaaacugcaucaacagguguuuuuauguggaguugauaagagggagaccacaggagaccagagugugguggacuucaaacagcaucauuguauucuguggaaccucagguacauauggaacaggcucauggccugauggagcgaauaucaacuucaugccuauauaa

SEQ ID NO: 54063 - RNA, 1401 nt, Artificial Sequence
  neuraminidase__InfluenzaA__AGQ81774
augaauccaaaucagaagauaauagcaauuggcucuguuucucuaaucauugcgauaauaugucuccucaugcagauugccaucuuaacaacgacuaugacacuacauuucaggcagaaugaaugcaguaacccaucgaauaaucaagugaugccaugugaaccgaucauaauagagaggaacacagugcauuugaauagcacuaccauagagagggaaauuuguccuaaaguagcagaauacaagaauuggucaaaaccacaaugucaaauuacaggguucgcuccuuucucaaaggacaacucaauuaggcuuucugcagguggggauaucugggugacaagagaaccuuaugucucaugcagucucgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaagggaaaauuauaaauauuagcccauugucaggaagugcucagcacguugaggaaugcuccuguuauccccgguauccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauagcuaauucaaagucacagauaaauaggcaagucauaguugacagugacgacuggucuggguauucuggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54064 - RNA, 1401 nt, Artificial Sequence
  neuraminidase__InfluenzaA__AGQ81776
augaauccaaaucagaagauaauagcaauuggcucuguuucucuaaccauugcgauaauauguuuucucaugcagauugccaucuuaacaacgaccaugacacuacauuucaggcagaaugaaugcagcaauccaucgaauaaucaaguggugccaugugaaccuaucauaauagagaggaacacagugcauuugaauaguacuaccauagagaaggaaauuuguccuaaaguggcagaauacaagaauuggucaaaaccacaaugucaaauuacaggguuugcuccuuucucaaaagacaacucaauuaggcuuucugcagguggagauaucugggugacaagagaaccuuaugugucgugcagucuuggaaaauguuaucaguuugcacuugggcagggaaccacucugaaaaacaagcacucaaauggcacuacacacgacagaauuccucacagaacucuuuuaaugaaugaguuaggugucccauuucauuugggaaccaaacaagugugcauagcauggucuaguucaagcugccaugaugggaaagcaugguuacauauuugugugacuggggaugauaaaaaugcuacugcuaguauuauuuaugaugggaugcugguugacaguauugguucaugguccaaaaacauccuaaggacccaggagucagaaugcguuugcaucaauggaacuugugcaguaguaaugacugauggaagugcaucaggaaaggcugacacuagaguauuauucauaagagagggaaaaauuauaaauauuagcccauugucaggaagugcucagcacguggaggaaugcuccuguuacccccgguauccugaaguuagguguguuugcagagacaauuggaagggcuccaauaggcccguucuauauauaaauauggcagauuauaguauugaguccaguuauguaugcucaggacuuguuggcgacacaccaagagaugaugauagcuccaguagcagcaacuguagggacccuaauaacgaaagaggggccccaggaguaaaagggugggccuuugacgaugggaaugacauuuggaugggacgaacaaucaaaagugauucacgcucagguuaugagacuuuuagggucauugaugguuggaccacagcugauuccaagucacagauaaauaggcaagucauaguugacagugacagcuggucuggguauucugguaucuucucuguugaaggcaaaaacugcaucaacagguguuuuuauguggaguugauaagagggagaccacaggagaccagagugugguggacuucaaacagcaucauuguguucuguggaaccucagguacauauggaacaggcucauggccugauggagcgaauaucaacuucaugccuauauaa

SEQ ID NO: 54065 - RNA, 1410 nt, Artificial Sequence
  neuraminidase__InfluenzaA__AGQ81777
augaauccaaaucagaagauaguaacaauuggcuccgccucccuaacuauugcgacaaugugccuccuccugcagauugcccucuuugcuacaacuaugacacuacauuucaagcagacggggugcacaaacuccucugacaaucaagcagugccauguggaccaaucauaauagaaaggaacauaacagaaauagugcauuugaauagcaccacuuuagaaaaggaaacuuguccuaagucagcaggauacaggaauuggucuaaaccacaaugucaaaucacaggauucgcuccuuucuccaaggacaauucaauuaggcuugcugcagcuggagauauuugggugacaagagaaccuuaugugucaugcggucuugguaaauguuaucaauuugcucuugggcaggggaccaccuuggacaacaaacacucaaauggcacaacacaugauagaacuccucauagaacccuuuuaaugaaugaguuggguguuccguuucauuuggcaaccaaacaaguguguauagcaugguccagcucaagcugccaugauggaaaagcaugguuacauguuugugucacaggggacgauaagaaugcaacugcuaguaucauuuaugaugggauacuuguugacagcauugcuucauggucuaaaaacauacucagaacucaagagucagaaugcguuuguauuaacggaaccuguacgguaguaaugacagauggaagugcaucaggaagggcugacaccagaauacuauuuauuagagaggggaaaaucguacacauuagcccauugucaggaagugcucagcauguugaggaaugcuccuguuaccccagauauccagaaguuagauguguuugcagagacaauuggaauggauccaauagacccguucuauuuauaaauauggcagauuauaguauugauuccaguuauguguguucagggcuugugggcgacacaccaagaaaugaugauagaucuagcagcagcaacugcagagauccuaauaacgaaagaggagccccaggagugaaagggugggccuucgacaguggaaaugauauuuggaugggaagaacgaucgaaaaggauucgcgcucagguuaugagacuuucagggucauuagugguuggagcacagcuaauuccaagucacagauaaauagacaagucauaguugaucgugauaacucgucuggguauucugguauuuucucuguugaaggcaaaagcugcaucaacagguguuuuuauguagagcugauaagaggaagaccaaaagagaauagagugugguggacuucaaacagcaucauuguauuuuguggaacuucagguacuuauggaacaggcucauggccugauggggcgaauaucaaucucaugccgauauaa

SEQ ID NO: 54066 - RNA, 1410 nt, Artificial Sequence
  neuraminidase__InfluenzaA__AGQ81778
augaauccaaaucagaagauaguaacaauuggcuccgccucccuaacuauugcgacaaugugccuccuccugcagauugcccucuuugcuacaacuaugacacuacauuucaagcagacggggugcacaaacuccucugacaaucaagcagugccauguggaccaaucauaauagaaaggaacauaacagaaauagugcauuugaauagcaccacuuuagaaaaggaaacuuguccuaagucagcaggauacaggaauuggucuaaaccacaaugucaaaucacaggauucgcuccuuucuccaaggacaauucaauuaggcuugcugcagcuggagauauuugggugacaagagaaccuuaugugucaugcggucuugguaaauguuaucaauuugcucuugggcaggggaccaccuuggacaacaaacacucaaauggcacaacacaugauagaacuccucauagaacccuuuuaaugaaugaguuggguguuccguuucauuuggcaaccaaacaaguguguauagcaugguccagcucaagcugccaugauggaaaagcaugguuacauguuugugucacaggggacgauaagaaugcaacugcuaguaucauuuaugaugggauacuuguugacagcauugcuucauggucuaaaaacauacucagaacucaagagucagaaugcguuuguauuaacggaaccuguacgguaguaaugacagauggaagugcaucaggaagggcugacaccagaauacuauuuauuagagaggggaaaaucguacacauuagcccauugucaggaagugcucagcauguugaggaaugcuccuguuaccccagauauccagaaguuagauguguuugcagagacaauuggaagggauccaauagacccguucuauuuauaaauauggcagauuauaguauugauuccaguuauguguguucagggcuugugggcgacacaccaagaaaugaugauagaucuagcagcagcaacugcagagauccuaauaacgaaagaggagccccaggagugaaagggugggccuucgacaguggaaaugauauuuggaugggaagaacgaucgaaaaggauucgcgcucagguuaugagacuuucagggucauuagugguuggagcacagcuaauuccaagucacagauaaauagacaagucauaguugaucgugauaacucgucuggguauucugguauuuucucuguugaaggcaaaagcugcaucaacagguguuuuuauguagagcugauaagaggaagaccaaaagagaauagagugugguggacuucaaacagcaucauuguauuuuguggaacuucagguacuuauggaacaggcucauggccugauggggcgaauaucaaucucaugccgauauaa

SEQ ID NO: 54067 - RNA, 1410 nt, Artificial Sequence
  neuraminidase__InfluenzaA__AGQ81779
augaauccaaaucagaagauaguagcaauuggcuccgccucccuaacuauugcgacaaugugccuccuccugcagauugcccucuuugcuacaacuaugacacuacauuucaagcagacggggugcacaaacuccucugacaaucaagcagugccauguggaccaaucauaauagaaaggaacauaacagaaauagugcauuugaauagcaccacuuuagaaaaggaaacuuguccuaagucagcaggauacaggaauuggucuaaaccacaaugucaaaucacaggauucgccccuuucuccaaggacaauucaauuaggcuugccgcagcuggagauauuugggugacaagagaaccuuaugugucaugcggucuugguaaauguuaucaauuugcucuugggcaggggaccaccuuggacaacaaacacucaaauggcacaacacaugauagaacuccucauagaacccuuuuaaugaaugaguuggguguuccguuucauuuggcaaccaaacaaguguguauagcaugguccagcucaagcugccaugauggaaaagcaugguuacauguuugugucacaggggacgauaagaaugcaacugcuaguaucauuuaugaugggauacuuguugacagcauugcuucauggucuaaaaacauacucagaacucaagagucagaaugcguuuguauuaacggaaccuguacgguaguaaugacagauggaagugcaucaggaagggcugacaccagaauacuauuuauuagagaggggaaaaucguacacauuagcccauugucaggaagugcucagcauguugaggaaugcuccuguuacccccgauauccagaaauuagauguguuugcagagacaauuggaagggauccaauagacccguucuauuuauaaauauggcagauuauaguauugauuccaguuauguguguucagggcuugugggcgacacaccaagaaaugaugauagaucuagcagcagcaacugcagagauccuaauaacgaaagaggagccccaggagugaaagggugggccuucgacaguggaaaugauauuuggaugggaagaacgaucgaaaaggauucgcgcucagguuaugagacuuucagggucauuagugguuggagcacagcuaauuccaagucacagauaaauagacaagucauaguugaucgugauaacucgucuggguauucugguauuuucucuguugaaggcaaaagcugcaucaacagguguuuuuauguagagcugauaagaggaagaccaaaagagaauagagugugguggacuucaaacagcaucauuguauuuuguggaacuucagguacuuauggaacaggcucauggccugauggggcgaauaucaaucucaugccgauauaa

SEQ ID NO: 54068 - RNA, 1410 nt, Artificial Sequence
  neuraminidase__InfluenzaA__AGQ81780
augaauccaaaucagaagauaguggcaauuggcuccgccucccuaacuauugcgacaaugugccuccuccugcagauugcccucuuugcuacaacuaugacacuacauuucaagcagacggggugcacaaacuccucugacaaucaagcagugccauguggaccaaucauaauagaaaggaacauaacagaaauagugcauuugaauagcaccacuuuagaaaaggaaacuuguccuaagucagcaggauacaggaauuggucuaaaccacaaugucaaaucacaggauucgcuccuuucuccaaggacaauucaauuaggcuugccgcagcuggagauauuugggugacaagagaaccuuaugugucaugcggucuugguaaauguuaucaauuugcucuugggcaggggaccaccuuggacaacaaacacucaaauggcacaacacaugauagaacuccucauagaacccuuuuaaugaaugaauuggguguuccguuucauuuggcaaccaaacaaguguguauagcaugguccagcucaagcugccaugauggaaaagcaugguuacauguuugugucacaggggacgauaagaaugcaacugcuaguaucauuuaugaugggauacuuguugacagcauugcuucauggucuaaaaacauacucagaacucaagagucagaaugcguuuguauuaacggaaccuguacgguaguaaugacagauggaagugcaucaggaagggcugacaccagaauacuauuuauuagagaggggaaaaucguacacauuagcccauugucaggaagugcucagcauguugaggaaugcuccuguuacccccgauauccagaaguuagauguguuugcagagacaauuggaagggauccaauagacccguucuauuuauaaauauggcagauuauaguauugauuccaguuauguguguucagggcuugugggcgacacaccaagaaaugaugauagaucuagcagcagcaacugcagagauccuaauaacgaaagaggagccucaggagugaaagggugggccuucgacaguggaaaugauauuuggaugggaagaacgaucgaaaaggauucgcgcucagguuaugagacuuucagggucauuagugguuggagcacagcuaauuccaagucacagauaaauagacaagucauaguugaucgugauaacucgucuggguauucugguauuuucucuguugaaggcaaaagcugcaucaacagguguuuuuauguagagcugauaagaggaagaccaaaagagaauagagugugguggacuucaaacagcaucauuguauuuuguggaacuucagguacuuauggaacaggcucauggccugauggggcgaauaucaaucucaugccgauauaa

SEQ ID NO: 54069 - RNA, 1401 nt, Artificial Sequence
  neuraminidase__InfluenzaA__AGQ81781
augaauccaaaucagaagauaauagcaauuggcucuguuucucuaaccauugcgauaauauguuuucucaugcagauugccaucuuaacaacgaccaugacaccacauuucaggcagaaugaaugcagcaauccaucgaauaaucaaguggugccaugugaaccuaucauaauagagaggaacacugugcauuugaauaguacuaccauagagaaggaaauuugucccaaaguggcagaauacaagaauuggucaaaaccacaaugucaaauuacaggguuugcuccuuucucaaaggacaacucaauuaggcuuucugcagguggagauaucugggugacaagagaaccuuaugugucgugcagucuuggaaaauguuaccaguuugcacuugggcagggaaccacucugaaaaacaagcacucaaauggcacuacacaugauagaauuccucacagaacucuuuuaaugaaugaguuaggugucccauuucauuugggaaccaaacaagugugcauagcauggucuaguucaagcugccaugaugggaaagcaugguuacauauuugugugacuggggaugauaaaaaugcuacugcuaguaucauuuaugaugggaugcugguugacaguauugguucaugguccaaaaacauccuaagaacccaggagucagaaugcguuuguaucaauggaacuugugcaguaguaaugacugauggaagugcaucaggaaaggcugacacuagaauauuauucauaagagagggaaaaauuauaaauauuagcccauugucaggaagugcucagcacguggaggaaugcuccuguuacccccgguauccugaaguuaggugcguuuguagagacaauuggaagggcuccaauaggcccguucuauauauaaauauggcagauuauaguauugaguccaguuauguaugcucaggacuuguuggcgacacaccaagagaugaugauaguuccaguagcagcaacuguagagacccuaauaacgaaagaggggccccuggaguaaaagggugggccuuugacgaugggaaugacauuuggaugggacgaacaaucaaaagugauucacgcucagguuaugagacuuuuagggucguuaaugguuggaccacagcuaauuccaagucacagauaaauaggcaagucauaguugauagugacagcuggucuggguauucugguaucuucucuguugaaggcaaaaacugcaucaacagguguuuuuauguggaguugauaagagggagaccacaggagaccagagugugguggacuucaaacagcaucauuguauucuguggaaccucagguacauauggaacaggcucauggccugauggagcggauaucaacuuaaugccuauauaa

SEQ ID NO: 54070 - RNA, 1410 nt, Artificial Sequence
  neuraminidase__InfluenzaA__AGQ81783
augaauccaaaucagaagauaguaacaauuggcuccgccucccuaacuauugcgacaaugugccuccuccugcagauugcccucuuugcuacaacuaugacacuacauuucaagcagacggggugcacaaacuccucugacaaucaagcagugccauguggaccaaucauaauagaaaggaacauaacagaaauagugcauuugaauagcaccacuuuagaaaaggaaacuuguccuaagucagcaggauacaggaauuggucuaaaccacaaugucaaaucacaggauucgcuccuuucuccaaggacaauucaauuaggcuugcugcagcuggagauauuugggugacaagagaaccuuaugugucaugcggucuugguaaauguuaucaauuugcucuugggcaggggaccaccuuggacaacaaacacucaaauggcacaacacaugauagaacuccucauagaacccuuuuaaugaaugaguuggguguuccguuucauuuggcaaccaaacaaguguguauagcaugguccagcucaagcugccaugauggaaaagcaugguuacauguuugugucacaggggacgauaagaaugcaacugcuaguaucauuuauaaugggauacuuguugacagcauugcuucauggucuaaaaacauacucagaacucaagagucagaaugcguuuguauuaacggaaccuguacgguaguaaugacagauggaagugcaucaggaagggcugacaccagaauacuauuuauuagagaggggaaaaucguacacauuagcccauugucaggaagugcucagcauguugaggaaugcuccuguuaccccagauauccagaaguuagauguguuugcagagacaauuggaagggauccaauagacccguucuauuuauaaauauggcagauuauaguauugauuccaguuauguguguucagggcuugugggcgacacaccaagaaaugaugauagaucuagcagcagcaacugcagagauccuaauaacgaaagaggagccccaggagugaaagggugggccuucgacaguggaaaugauauuuggaugggaagaacgaucgaaaaggauucgcgcucagguuaugagacuuucagggucauuagugguuggagcacagcuaauuccaagucacagauaaauagacaagucauaguugaucgugauaacucgucuggguauucugguauuuucucuguugaaggcaaaagcugcaucaacagguguuuuuauguagagcugauaagaggaagaccaaaagagaauagagugugguggacuucaaacagcaucauuguauuuuguggaacuucagguacuuauggaacaggcucauggccugauggggcgaauaucaaucucaugccgauauaa

SEQ ID NO: 54071 - RNA, 1401 nt, Artificial Sequence
  neuraminidase__InfluenzaA__AGQ81784
augaauccaaaucagaagauaauagcaauuggcucuguuucucuaaccauugcgauaauauguuuucucaugcagauugccaucuuaacaacgaccaugacacuacauuucaggcagaaugaaugcagcaauccaucgaauaaucaaguggugccaugugaaccuaucauaauagagaggaacacagugcauuugaauaguacuaccauagagaaggaaauuuguccuaaaguggcagaauacaagaauuggucaaaaccacaaugccaaauuacaggguuugcuccuuucucaaaggacaauucaauuaggcuuucugcagguggagauaucuggguuacaagagaaccuuaugugucgugcagucuuggaaaauguuaucaguuugcacuugggcagggaaccacucugagaaacaagcacucaaauggcacuacacacgauagaauuccucacagaacucuuuuaaugaaugaguuaggugucccauuucauuugggaaccaaacaagugugcauagcauggucuaguucaagcugccaugaugggaaagcaugguuacauauuugugugacuggggaugauaaaaaugcuacugcuaguaucauuuaugaugggaugcugguugacaguauugguucaugguccaaaaacauccuaagaacccaggagucagaaugcguuugcaucaauggaacuugugcaguaguaaugacugauggaaaugcaucgggaaaggcugacacuagaguguuauucauaagagagggaaaaauuauaaauauuagcccauugucaggaagugcucagcacguggaggaaugcuccuguuacccccgguauccugaaguuagguguguuugcagagauaauuggaagggcuccaauaggcccguucuauauauaaauauggcagauuauaguauugaguccaguuaugucugcucaggacuuguuggcgacacaccaagagaugaugauagcuccaguagcagcaacuguagagacccuaauaacgaaagaggggccccaggaguaaaagggugggccuuugacgaugggaaugacauuuggaugggacgaacaaucaaaagugauucacgcucagguuaugagacuuuuagggucguuaaugguuggaccacagcuaauuccaagucacagauaaauaggcaagucauaguugacagugacagcuggucuggguauucugguaucuucucuguugaaggcaaaaacugcaucaacagguguuuuuauguggaguugauaagagggagaccacaggagaccagagugugguggacuucaaacagcaucauuguauucuguggaaccucagguacauauggaacaggcucauggccugauggagcggauaucaacuucaugccuauauaa

SEQ ID NO: 54072 - RNA, 1401 nt, Artificial Sequence
  neuraminidase__InfluenzaA__AGQ81785
augaauccaaaucagaagauaauagcaauuggcucuguuucucuaaccauugcgauaauauguuuuaucaugcagauugccaucuuaacaacgaccaugacaccacauuucaggcagaaugaaugcagcaauccaucgaauaaucaaguggugccaugugaaccuaucauaauagagaggaacacugugcauuugaauaguacuaccauagagaaggaaauuugucccaaaguggcagaauacaagaauuggucaaaaccacaaugucaaauuacaggguuugcuccuuucucaaaggacaacucaauuaggcuuucugcagguggagauaucugggugacaagagaaccuuaugugucgugcagucuuggaaaauguuaccaguuugcacuugggcagggaaccacucugaaaaacaagcacucaaauggcacuacacaugauagaauuccucacagaacucuuuuaaugaaugaguuaggugucccauuucauuugggaaccaaacaagugugcauagcauggucuaguucaagcugccaugaugggaaagcaugguuacauauuugugugacuggggaugauaaaaaugcuacugcuaguaucauuuaugaugggaugcugguugacaguauugguucaugguccaaaaacauccuaagaacccaggagucagaaugcguuuguaucaauggaacuugugcaguaguaaugacugauggaagugcaucaggaaaggcugacacuagaauauuauucauaagagagggaaaaauuauaaauauuagcccauugucaggaagugcucagcacguggaggaaugcuccuguuacccccgguauccugaaguuaggugcguuuguagagacaauuggaagggcuccaauaggcccguucuauauauaaauauggcagauuauaguauugaguccaguuauguaugcucaggacuuguuggcgacacaccaagagaugaugauaguuccaguagcagcaacuguagagacccuaauaacgaaagaggggccccuggaguaaaagggugggccuuugacgaugggaaugacauuuggaugggacgaacaaucaaaagugauucacgcucagguuaugagacuuuuagggucguuaaugguuggaccacagcuaauuccaagucacagauaaauaggcaagucauaguugacagugacagcuggucuggauauucugguaucuucucuguugaaggcaaaaacugcaucaacagguguuuuuauguggaguugauaagagggagaccacaggagaccagagugugguggacuucaaacagcaucauuguauucuguggaaccucagguacauaugggacaggcucauggccugauggagcggauaucaacuuaaugccuauauaa

SEQ ID NO: 54073 - RNA, 1401 nt, Artificial Sequence
  neuraminidase__InfluenzaA__AGQ81787
augaauccaaaccagaagauaauagcaauuggcucuguuucucuaaucauugcgauaauaugucuccucaugcagauugccaucuuaacaacgacuaugacacuacauuucaggcagaaugaaugcaguaacccaucgaauaaucaaguggugccaugugaaccaaucauaauagagaggaacacagugcauuugaauagcacuaccauagagagggaaauuuguccuaaaguagcagaauacaagaauuggucaaaaccacaaugucaaauuacaggguucgcuccuuuuucaaaggacaacucaauuaggcuuucugcagguggggauaucugggugacaagagaaccuuaugucucaugcagucucgacaaauguuaucaauuugcacuugggcagggaaccacccugaaaaacaagcacucaaauggcacuacacaugauagaaccccucacagaacucuuuuaaugaaugaguuaggugucccauuucaucugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaagggaaaauuauaaauauuagcccauugucaggaagugcucagcacguugaggaaugcuccuguuauccccgguauccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauggcuaauucaaagucacagauaaauaggcaagucauaguugacagugacgacuggucuggguauucuggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54074 - RNA, 1401 nt, Artificial Sequence
  neuraminidase__InfluenzaA__AGQ81789
augaauccaaaucagaagauaauagcaauuggcucuguuucucuaaccauugcgauaauaugucuucucaugcagauugccaucuuaacaacgaccaugacaccacauuucaggcagaaugaaugcagcaauccaucgaauaaucaaguggugccaugugaaccuaucauaauagagaggaacacugugcauuugaauaguacuaccauagagaaggaaauuugucccaaaguggcagaauacaagaauuggucaaaaccacaaugucaaauuacaggguuugcuccuuucucaaaggacaacucaauuaggcuuucugcagguggagauaucugggugacaagagaaccuuaugugucgugcagucuuggaaaauguuaccaguuugcacuugggcagggaaccacucugaaaaacaagcacucaaauggaaccacacaugauagaauuccucacagaacucuuuuaaugaaugaguuaggugucccauuucauuugggaaccaaacaagugugcauagcauggucuaguucaagcugccaugaugggaaagcaugguuacauauuugugugacuggggaugauaaaaaugcuacugcuaguaucauuuaugaugggaugcugguugacaguauugguucaugguccaaaaacauccuaagaacccaggagucagaaugcguuuguaucaauggaacuugugcaguaguaaugacugauggaagugcaucaggaaaggcugacacuagaauauuauucauaagagagggaaaaauuauaaauauuagcccauugucaggaagugcucagcacguggaggaaugcuccuguuacccccgguauccugaaguuaggugcguuuguagagacaauuggaagggcuccaauaggcccguucuauauauaaauauggcagauuauaguauugaguccaguuauguaugcucaggacuuguuggcgacacaccaagagaugaugauaguuccaguagcagcaacuguagagacccuaauaacgaaagaggggccccuggaguaaaagggugggccuuugacgaugggaaugacauuuggaugggacgaacaaucaaaagugauucacgcucagguuaugagacuuuuagggucguuaaugguuggaccacagcuaauuccaagucacagauaaauaggcaagucauaguugacagugacagcuggucuggauauucugguaucuucucuguugaaggcaaaaacugcaucaacagguguuuuuauguggaguugauaagagggagaccacaggagaccagagugugguggacuucaaacagcaucauuguauucuguggaaccucagguacauauggaacaggcucauggccugauggagcggauaucaacuuaaugccuauauaa

SEQ ID NO: 54075 - RNA, 1401 nt, Artificial Sequence
  neuraminidase__InfluenzaA__AGQ81790
augaauccaaaucagaagauaauagcaauuggcucuguuucucuaaucauugcgauaauaugucuccucaugcagauugccaucuuaacaacgacuaugacacuacauuucaggcagaaugaaugcagcaacccaucgaacaaucaagcgaugccaugugaaccgaucauaauagagaggaacacagugcauuugaauaguacuaccauagagagggaaauuuguccuaaaguaacagaauacaagaauuggucaaaaccacaaugucaaauuacaggguuugcuccuuucucaaaagacaacucaauuaggcuuucugcagguggggauaucugggugacaagagaaccuuaugucucaugcagucucgauaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacucaggagucagaaugcguuugcaucaauggaacuugugcagugguaaugacugauggaagugcaucaggaagggccgacacuagaguauuauucauaagagaaggaaaaauuauaaauauuagcccauugucaggaaaugcucagcacguugaggaaugcuccuguuauccccgguauccugaaguuagguguguuugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauggcuaauucaaagucacagauaaauaggcaagucauaguugacagugacgaauggucuggguauucuggcaucuucucuguugaaggcaaaaaaugcaucaacagguguuuuuauguggaguugauaagagggagaccacaggaacccagagugugguggaccucaaacagcaucauuguauucuguggaaccucagguacauauggaacaggcucauggccugauggagcaaauaucaauuucaugccuauauaa

SEQ ID NO: 54076 - RNA, 1401 nt, Artificial Sequence
  neuraminidase__InfluenzaA__AGQ81792
augaauccaaaucagaagauaauagcaauuggcucuguuucucuaaucauugcgauaauaugucuccucaugcagauugccaucuuaacaacgacuaugacacuacauuucaggcagaaugaaugcaguaacccaucgaauaaucaagugaugccaugugaaccgaucauaauagagaggaacacagugcauuugaauaguacuaccauagagagggaaauuuguccuaaaguagcagaauacaagaauuggucaaaaccacaaugucaaauuacaggguucgcuccuuucucaaaggacaacucaauuaggcuuucugcagguggggauaucugggugacaagagaaccuuaugucucaugcagucucaacaaauguuaucaauuugcacuugggcagggaaccacccuggaaaacaagcacucaaauggcacuacacaugauaggaccccucacagaacucuuuuaaugaaugaauuaggugucccauuucauuugggaaccaaacaagugugcauggcauggucuaguucaagcugcuaugauggaaaagcaugguuacauauuuguguuacuggggaugauaaaaaugcuacugcuagugucaucuaugaugggaugcuuguugacaguauugguucauggucccaaaacauccucagaacucaggagucagaaugcguuugcaucaauggaacuugugcagugguaaugacugauggaagugcaucaggaaaggccgacacuagaguauuauucauaagagaagggaagauuauaaauauuagcccauugucaggaagugcucagcacguugaggaaugcuccuguuauccccgguauccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauggcuaauucaaagucacagauaaauaggcaagucauaguugacagugacgacuggucuggguauucuggcaucuucucuguugaaggcaaaaaaugcaucaacagguguuuuuauguggaguuaauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54077 - RNA, 1401 nt, Artificial Sequence
  neuraminidase__InfluenzaA__AGQ81793
augaauccaaaucagaagauaauagcaauuggcucuguuucucuaaucauugcgauaauaugucuccucaugcagauugccaucuuaacaacgacuaugacacuacauuucaggcagaaugaaugcaguaacccaucgaauaaucaagugaugccaugugaaccgaucauaauagagaggaacacagugcauuugaauaguacuaccauagagagggaaauuuguccuaaaguagcagaauacaagaauuggucaaaaccacaaugucaaauuacaggguucgcucccuucucaaaggacaacucaauuaggcuuucugcagguggggauaucugggugacaagagaaccuuaugucucaugcagucucaacaaauguuaucaauuugcacuugggcagggaaccacccuggaaaacaagcacucaaauggcacuacacaugauaggaccccucacagaacucuuuuaaugaaugaauuaggugucccauuucauuugggaaccaaacaagugugcauggcauggucuaguucaagcugcuaugauggaaaagcaugguuacauauuuguguuacuggggaugauaaaaaugcuacugcuagugucaucuaugaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaagggaagauuauaaauauuagcccauugucaggaagugcucagcacguugaggaaugcuccuguuauccccgguauccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauggcuaauucaaagucacagauaaauaggcaagucauaguugacagugacgacuggucuggguauucuggcaucuucucuguugaaggcaaaaaaugcaucaacagguguuuuuauguggaguuaauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54078 - RNA, 1401 nt, Artificial Sequence
  neuraminidase__InfluenzaA__AGQ81794
augaauccaaaucagaagauaauagcaauuggcucuguuucucuaaucauugcgauaauaugucuccucaugcagauugccaucuuaacaacgacuaugacacuacauuucaggcagaaugaaugcaguaacccaucgaauaaucaagugaugccaugugaaccgaucauaauagagaggaacacagugcauuugaauaguacuaccauagagagggaaauuuguccuaaaguagcagaauacaagaauuggucaaaaccacaaugucaaauuacaggguucgcuccuuucucaaaggacaacucaauuaggcuuucugcagguggggauaucugggugacaagagaaccuuaugucucaugcagucucaacaaauguuaucaauuugcacuugggcagggaaccacccuggaaaacaagcacucaaauggcacuacacaugauaggaccccucacagaacucuuuuaaugaaugaauuaggugucccauuucauuugggaaccaaacaagugugcauggcauggucuaguucaagcugcuaugauggaaaagcaugguuacauauuuguguuacuggggaugauaaaaaugcuacugcuagugucaucuaugaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaagggaagauuauaaauauuagcccauugucaggaagugcucagcacguugaggaaugcuccuguuauccccgguauccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauggcuaauucaaagucacagauaaauaggcaagucauaguugacagugacgacuggucuggguauucuggcaucuucucuguugaaggcaaaaaaugcaucaacagguguuuuuauguggaguuaauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54079 - RNA, 1401 nt, Artificial Sequence
  neuraminidase__InfluenzaA__AGQ81795
augaauccaaaucagaagauaauagcaauuggcucuguuucucuaaucauugcgauaauaugucuccucaugcagauugccaucuuaacaacgacuaugacacuacauuucaggcagaaugaaugcaauaacccaucgaauaaucaagugaugccaugugaaccgaucauaauagagaggaacacagugcauuugaauagcacuaccauagagagggaaauuuguccuaagguagcagaauacaagaauuggucaaaaccacaaugucaaauuacaggguucgcuccuuuuucaaaggacaacucaauuaggcuuucugcagguggggauaucugggugacaagagaaccuuaugucucaugcagucucgacaaauguuaucaauuugcacuugggcagggaaccacccugaaaaacaagcacucgaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacucaggagucagaaugcguuugcaucaauggaacuugugcagugguaaugacugauggaagugcaucaggaaaagccgacacuagaguauuauucauaagagaagggaaaauuauaaauauuagcccauugucaggaagugcucagcacguugaggaaugcuccuguuauccccgguauccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauagcuaauucaaagucacagauaaauaggcaaaucauaguugauagugacgacuggucuggguauucuggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54080 - RNA, 1401 nt, Artificial Sequence
  neuraminidase__InfluenzaA__AGQ81796
augaauccaaaccagaagauaauagcaauuggcucuguuucucuaaucauugcgauaauaugucuccucaugcagauugccaucuuaacaacgacuaugacacuacauuucaggcagaaugaaugcaguaacccaucgaauaaucaagugaugccaugugaaccaaucauaauagagaggaacacagugcauuugaauagcacuaccauagagagggaaauuuguccuaaaguagcagaauacaagaauuggucaaaaccacaaugucaaauuacaggguucgcuccuuucucaaaggacaacucaauuaggcuuucugcagguggggauaucugggugacaagagaaccuuaugucucaugcagucucgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaagggaaaauuauaaauauuagcccauugucaggaagugcucagcacguugaggaaugcuccuguuauccccgguauccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauauuuggaugggacggacaaucaaaaaugguucacgcucagguuaugagacuuuuagggucgucaaugguuggaccauggcuaauucaaagucacagauaaauaggcaagucauaguugacagugacgacuggucuggguauucuggcaucuucucuguugaaggcaaaaaaugcaucaacagguguuuuuauguggaguugauaagagggagaccacaggaaccuagagugugguggaccucaaauagcaucauuguauucuguggaaccucagguacauauggaacaggcucauggccugauggagcgaauaucaacuucaugccuauauaa

SEQ ID NO: 54081 - RNA, 1401 nt, Artificial Sequence
  neuraminidase__InfluenzaA__AGQ81798
augaauccaaaucagaagauaauaucaauuggcucuguuucucuaaucauugcgauaauaugucuccucaugcagauugccaucuuaacaacgacuaugacacuacauuucaggcagaaugaaugcaguaacccaucgaauaaucaagugaugccaugugaaccgaucauaauagagaggaacacagugcauuugaauagcacuaccauagagagggaaauuuguccuaaaguagcagaauacaagaauuggucaaaaccacaaugucaaauuacaggguucgcuccuuucucaaaggacaacucaauuaggcuuucugcagguggggauaucugggugacaagagaaccuuaugucucaugcagucucgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaagggaaaauuauaaauauuagcccauugucaggaagugcucagcacguugaggaaugcuccuguuauccccgguacccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauggcuaauucaaagucacagauaaauaggcaagucauaguugacagugacgacuggucuggguauucuggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54082 - RNA, 1401 nt, Artificial Sequence
  neuraminidase__InfluenzaA__AGQ81799
augaauccaaaucagaagauaauagcaauuggcucuguuucucuaaucauugcgauaauaugucuccucaugcagauugccaucuuaacaacgacuaugacacuacauuucaggcagaaugaaugcaguaacccaucgaauaaucaagugaugccaugugaaccgaucauaauagagaggaacacagugcauuugaauagcacuaccauagagagggaaauuuguccuaaaguagcagaauacaagaauuggucaaaaccacaaugucaaauuacaggguucgcuccuuucucaaaggacaacucaauuaggcuuucugcagguggggauaucugggugacaagagaaccuuaugucucaugcagucucgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaagggaaaauuauaaauauuagcccauugucaggaagugcucagcacguugaggaaugcuccuguuauccccgguacccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauggcuaauucaaagucacagauaaauaggcaagucauaguugacagugacgacuggucuggguauucuggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54083 - RNA, 1401 nt, Artificial Sequence; identical to SEQ ID NO: 54082
  neuraminidase__InfluenzaA__AGQ81800

SEQ ID NO: 54084 - RNA, 1401 nt, Artificial Sequence
  neuraminidase__InfluenzaA__AGQ81801
augaauccaaaucagaagauaauagcaauuggcucuguuucucuaaucauugcgauaauaugucuccucaugcagauugccaucuuaacaacgacuaugacacuacauuucaggcagaaugaaugcaguaacccaucgaauaaucaagugaugccaugugaaccgaucauaauagagaggaacacagugcauuugaauagcacuaccauagagagggaaauuuguccuaaaguagcagaauacaagaauuggucaaaaccacaaugucaaauuacaggguucgcuccuuucucaaaggacaacucaauuaggcuuucugcaaguggggauaucugggugacaagagaaccuuaugucucaugcagucucgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaagggaaaauuauaaauauuagcccauugucaggaagugcucagcacguugaggaaugcuccuguuauccccgguacccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauggcuaauucaaagucacagauaaauaggcaagucauaguugacagugacgacuggucuggguauucuggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54085 - RNA, 1401 nt, Artificial Sequence
  neuraminidase__InfluenzaA__AGQ81802
augaauccaaaucagaagauaauagcaauuggcucuguuucucuaaucauugcgauaauaugucuccucaugcagauugcccucuuaacaacgacuaugacacuacauuucaggcagaaugaaugcaguaacccaucgaauaaucaagugaugccaugugaaccgaucauaauagagaggaacacagugcauuugaauagcacuaccauagagagggaaauuuguccuaaaguagcagaauacaagaauuggucaaaaccacaaugucaaauuacaggguucgcuccuuucucaaaggacaacucaauuaggcuuucugcagguggggauaucugggugacaagagaaccuuaugucucaugcagucucgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuauaaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaaggggaaauuauaaauauuagcccauugucaggaagugcucagcacguugaggaaugcuccuguuauccccgguacccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauggcuaauucaaagucacagauaaauaggcaagucauaguugacagugacgacuggucuggguauucuggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54086 - RNA, 1401 nt, Artificial Sequence
  neuraminidase__InfluenzaA__AGQ81803
augaauccaaaucagaagauaauagcaauuggcucuguuucucuaaucauugcgauaauaugucuccucaugcagauugccaucuuaacaacgacuaugacacuacauuucaggcagaaugaaugcaguaacccaucgaauaaucaagugaugccaugugaaccgaucauaauagagaggaacacagugcauuugaauagcacuaccauagagagggaaauuuguccuaaaguagcagaauacaagaauuggucaaaaccacaaugucaaauuacaggguucgcuccuuucucaaaggacaacucaauuaggcuuucugcaaguggggauaucugggugacaagagaaccuuaugucucaugcagucucgacaaauguuaucaauuugcacuugggcagggaaccacccugaaaaacgagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaagggaaaauuauaaauauuagcccauugucaggaagugcucagcacguugaggaaugcuccuguuauccccgguacccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaucauggcuaauucaaagucacagauaaauaggcaagucauaguugacagugacgacuggucuggguauucuggcauauucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54087 - RNA, 1410 nt, Artificial Sequence
  neuraminidase__InfluenzaA__AGQ81804
augaauccaaaucagaagaugauagcaauuggggccgucucucuaacuauugcgauaauaugccuccucaugcagaccgccaucuuagucacgaccaugacacuacauuucaagcauaaugaaugcaccaacuccucgaacaaucaagcagccccauguggaccaaucauaauagaaaggaacguaacugagguagugcaccuaaauagcacuaccuuagagaaggaaauauguccuaaagcagcaggauacaggaauuggucgaaaccacaaugucagauaacaggguucgcuccuuucuccaaggacaauucaauuaggcucuccgcagguggagauauuugggugacaagagagccuuauguaucauguggucuugguaaauguuaucaguuugcacuugggcaggggacuaccuuggacaacagucacucaaauggcacaucacaugauaggacuccucauaggacacuuuugaugaaugaguuggguguuccauuucauuugaugaccaaacaagugugcauagcaugguccagcucaagcugucaugaugggaaagcaugguuacauguuuguguuacuggagaugauagaaaugcaacugccaguaucaucuauggugguauacuuguugauagcauugguucauggucaaaaaauauccucagaacucaggagucagaauguguuugcaucaauggaaccugugcgguaguaaugacagauggaagugcuucagggaaagcugacacuagaauacuauucauuagagaggggaaaauaguacacauuagcccuuugucaggaagugcucagcauguggaggaaugcuccuguuacccccaauacccagaaguuagguguguuuguagagacaauuggaggggaucuaauagacccguucuauacauaaauauggcagauuauaguauugauuccgguuaugugugcucgggacuuguuggugacacaccaagaaaugacgauguaucuagcagcagcaauugcaaggauccuaauaaugaaagaggggcuccaggagugaaagggugggccuuugacaauggaaaugacauuuggaugggaagaacuauugauaaggauucgcgcucagguuaugagacuuucagggucauugaugguuggaacacggcuaauucuaagucacagacaaguagacaagucauaguuggcagugacaauucguccggguauucuggaauuuucuccguugaaggcaaaagcugcaucaacagguguuuuuauguagagcuaaucagagggagaccaaaggagacuagagugugguggacuucaaauaguauuauuguauucuguggaacuucagguacuuauggaacaggcucauggccugauggugcaaauaucaauuucaugccuauauaa

SEQ ID NO: 54088 - RNA, 1401 nt, Artificial Sequence
  neuraminidase__InfluenzaA__AGQ81805
augaauccaaaucagaagauaauagcaauuggcucuguuucucuaaucauugcgauaauaugucuccucaugcagauugcccucuuaacaacgacuaugacacuacauuucaggcagaaugaaugcaguaacccaucgaauaaucaagugaugccaugugaaccgaucauaauagagaggaacacagugcauuugaauagcacuaccauagagagggaaauuuguccuaaaguagcagaauacaagaauuggucaaaaccacaaugucaaauuacaggguucgcuccuuuuucaaaggacaacucaauuaggcuuucugcagguggggauaucugggugacaagagaaccuuaugucucaugcagucucgacaaauguuaucaauuugcacuugggcagggaaccaccaugaaaaacaagcacucaaauggcacuacacaugauagaaccccucacagaacucuguuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaagggaaaauuauaaauauuagcccauugucaggaagugcucagcacguugaggaaugcuccuguuauccccgguacccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagaggcccuaauaacgaaagaggggccccaggagugaaagggugggccuuugacgacgggaaugauguuuggaugggacggacaaucaaaaaugguucacgcucagguuaugagacuuuuagggucgucaaugguuggaccauggcuaauucaaagucacagauaaauaggcaagucauaguugacagugacgacuggucuggguauucuggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54089 - RNA, 1401 nt, Artificial Sequence
  neuraminidase__InfluenzaA__AGQ81807
augaauccaaaccagaagauaacagcaauuggcucuauuucucuaaucauugcgauaauaugucuccucaugcagauugccauccuaacaacgacuaugacacuacauuucaggcagaaugaaugcagaaacccaucgaauaaucaagugaugccaugugaaccagucauaauagagaggaacacagugcauuugaauagcacuaccauagagagggaaauuuguccuaaaguagcagaauacaagaauuggucaaaaccacaaugucaaauuacaggguucgcuccuuuuucaaaggacaacucaauuaggcuuucugcaaguggggauaucugggugacaagagaacccuaugucucaugcagucucaacaaauguuaucaauuugcacuugggcagggaaccacccugaaaaacaagcacucaaauggcacuacacaugauagaaccccucacagaacucuuuuaaugaaugaguuaggugucccauuccauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacccaggagucagaaugcguuugcaucaauggaacuugugcagugguaaugacugauggaagugcaucaggaaaggccgacacuagaguauuauuuauaaaagaagggaaaauuauaaauauuagcccauugucaggaagugcucagcacguugaggaaugcuccuguuauccccgauauccugaaguuaggugugucuguagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaucauggcuaauucaaagucacagauaaauaggcaagucauaguugacagugacgacuggucuggguauucuggcaucuucucuguugaaggcaaaaaaugcaucaacagguguuuuuauguggagcugauaagagggagaccacaggaacccagagugugguggaccucaaauagcaucauuguauucuguggaaccucagguacauauggaacaggcucauggccugauggagcgaauaucaacuucaugccuauauaa

SEQ ID NO: 54090 - RNA, 1401 nt, Artificial Sequence
  neuraminidase__InfluenzaA__AGQ81808
augaauccaaaucagaagauaauagcaauuggcucuguuucucuaaccauugcgauaauaugcuuccucaugcagauugccauccuaacaacgaccaugacacuacauuucaagcaaaaugaaugcagcaacccaucaaauaaucaaguggugccaugugaaccgauccuaauagagaggaacacagugcauuugaauaguacuaccauagagaaggaaguuuguccuaaaguggcagaauacaagaauuggucaaaaccacaaugucaaauuacaggguucgcuccuuucucaaaggacaacucaauuaggcuuucugcagguggagauaucuggguaacaagagaaccuuauguuucaugcagucuuggcaaauguuaucaauuugcacuugggcagggaaccacccugaaaaacaaucacucaaauggcaccacacaugauagaacuccucacagaacucuuuuaaugaaugaguuaggugucccauuucauuugggaaccaaacaagugugcauagcauggucuaguucaaguugcuaugauggaaaagcaugguuacauauuuguguuacuggggaugauaaaaaugcuacugcuaguaucauuuaugaugggaugcuuguugacaguauugguucaugguccaaaaacauccucagaacccaggagucagaaugcguuugcaucaauggaacuugugcaguaguaaugacugaugggagugcaucaggaaaggcugacacuagaauauuauucauaagagaggggaaaauuauaaacauuagcccauuaucagggagugcucagcauguugaggaaugcucauguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauagcuccagcagcagcaauugcagagacccuaauaacgaaagaggggccccaggagugaaaggaugggccuuugacgaugguaaugauguuuggaugggacgaacaaucagaaauaauucacgcucagguuaugagaccuuuaggguagucaaugguuggaccacggcuaauucaaagucacaaauaaauaggcaaaucauaguugacagugaaaacuggucuggguauucugguaucuucucuguugaaggcaaaaacugcaucaacaggugcuuuuauguggagcugauaagagggaggccacaggagcccagagugugguggacuucaaauagcaucauuguauucuguggaaccucagguacauaugggacaggcucauggccugauggagcgaauaucaacuucaugccuauauaa

SEQ ID NO: 54091 - RNA, 1401 nt, Artificial Sequence
  neuraminidase__InfluenzaA__AGQ81809
augaauccaaaucagaagauaacagcaauuggcucuguuucucuaaucauugcgauaauaugucuccucaugcaaauugccaucuuaacaacgacuaugacauuacauuucagacagaaugaaugcaguaacccaucgaauaaucaagugaugccaugugaaccgaucauaauagagaggaacacagugcauuugaauaguacuaccauagagagggaaauuuguccuaaaguagcagaauacaagaauuggucaaaaccacaaugucaaauuacaggguucgcuccuuucucaaaggacaacucaauuaggcuuucugcagguggggauaucugggugacaagagaaccuuaugucucaugcagucccgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauuggcucaugguccaaaaacauccucagaacucaggagucagaaugcguuugcaucaauggaacuugugcagugguaaugaccgauggaagugcaucaggagaggccgacacuagaauauuauucauaagagaaggaaaaauuauaaauaucagcccauugucaggaagugcucagcacguugaggaaugcuccuguuauccccgguauccugaaguuagguguguuugcagagacaauuggaagggcuccaauaggcccauuauauauauaaacaugguugauuauagcauugggucccguuaugugugcucaggacuugucggcgacacaccaagaaaugaugauagcaccagcagcagcaauugcagagacccuaauaacgaaagaggggccccaggagugaaagggugggccuuugacgacgggaaugauguuuggauggggcggacaaucaaaaauggcucacgcucagguuaugagacuuuuagggucaucaacgguuggaccauggcuaauucaaagucacagauaaauaggcaagucauaguugacagugacaacuggucuggguauuccggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcggauaucaacuucaugccuauauaa

SEQ ID NO: 54092 - RNA, 1401 nt, Artificial Sequence
  neuraminidase__InfluenzaA__AGQ81810
augaauccaaaucagaagauacuagcaauuggcucuguuucucuaaccauugcgauaauaugcuuccucaugcagauugccaucuuaacaacgacuaugacacuacauuucaagcaaaaugaaugcagcaacccaucaaauaaucaaguggugccaugugaaccgauccuaauagagaggaacacagugcauuugaauaguacuaccauagagaaggaaguuuguccuaaaguggcagaauacaagaauuggucaaaaccacaaugucaaauuacaggguucgcuccuuucucaaaggacaacucaauuaggcuuucugcagguggagauaucuggguaacaagagaaccuuauguuucaugcagucuuggcaaauguuaucaauuugcacuugggcagggaaccacccugaaaaacaaucacucaaauggcaccacacaugauagaacuccucacagaacucuuuuaaugaaugaguuaggugucccauuucauuugggaaccaaacaagugugcauagcauggucuaguucaaguugcuaugauggaaaagcaugguuacauauuuguguuacuggggaugauaaaaaugcuacugcuaguauuauuuaugaugggaugcuuguugacaguauugguucaugguccaaaaacauccucagaacccaggagucagaaugcguuugcaucaauggaacuugugcaguaguaaugacugaugggagugcaucaggaaaggcugacacuagaauauuauucauaagagaggggaaaauuauaaacauuagcccauuaucagggagugcucagcauguugaggaaugcucauguuauccccgguauccugaaguuagguguguuugcagagacaauuggaaaggcuccaauaggcccguucuauauauaaauauggcagauuauaguauugaguccaguuaugugugcucaggacuuguuggcgacacaccaagaaaugaugauagcuccagcagcagcaauugcagagacccuaauaacgaaagaggggccccaggagugaaaggaugggccuuugacgaugguaaugauguuuggaugggacgaacaaucagaaauaauucacgcucagguuaugagaccuuuaggguagucaaugguuggaccacggcuaauucaaagucacaaauaaauaggcaagucauaguugacagugaaaacuggucuggguauucugguaucuucucuguugaaggcaaaaacugcaucaacaggugcuuuuauguggagcugauaagagggaggccacaggagcccagagugugguggacuucaaauagcaucauuguauucuguggaaccucagguacauaugggacaggcucauggccugauggagcgaauaucaacuucaugccuauauaa

SEQ ID NO: 54093 - RNA, 1401 nt, Artificial Sequence
  neuraminidase__InfluenzaA__AGQ81811
augaauccaaaucagaagauaauagcaauuggcucuguuucucuaaccauugcgauaauauguuuccucaugcagauugccaucuuaacaacgacuaugacccuacauuucaagcaaaaugaaugcagcaacccaucaaauaaucaaguggugccaugugaaccaauccuaauagagaggaacacagugcauuugaauaguacuaccauagagaaggaaguuuguccuaaaguggcagaauacaagaauuggucaaaaccacaaugucaaauuacuggguucgcuccuuucucaaaggacaacucaauuaggcuuucugcagguggagauaucuggguaacaagagagccuuauguuucaugcagucuuggcaaauguuaucaauuugcacuugggcagggaaccacccugaaaaacaagcacucaaauggcaccacacaugauagaacuccucacagaacucuuuuaaugaaugaauuaggugucccauuccauuugggaaccaaacaagugugcauagcauggucuaguucaaguugcuaugauggaaaagcaugguuacauauuuguguuacuggggacgauaaaaaugccacugcuaguaucauuuaugaugggaugcuuguugacaguauugguucaugguccaaaaacauccucagaacccaggagucagaaugcguuugcaucaauggaacuugugcaguaguaaugacugauggaagugcaucaggaaaggcugacacuagaauauuauucauaagggaggggaaaauuguaaacauuagcccauugucagggagugcucagcacguugaggaaugcuccuguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauagcuucagcagcagcaauugcagagacccuaauaacgaaagaggggccccaggagugaaaggaugggccuuugacgaugguaaugauguuuggaugggacgaacaaucagaaaugauucacgcucagguuaugagacuuuuaggguagucaaugguuggaccacggcuaauucaaagucacaaauaaauaggcaagucauaguugacagugaaagcuggucuggguauucugguaucuucucuguugaaggcaaaaacugcaucaacagguguuuuuauguggaguugauaagagggagaccacaggagccuagagugugguggacuucaaauagcaucauuguauucuguggaaccucagguacauauggaacaggcucauggccugauggagcgaauaucaacuucaugccuauauaa

SEQ ID NO: 54094 - RNA, 1410 nt, Artificial Sequence
  neuraminidase__InfluenzaA__AGQ81812
augaauccaaaucagaagauaauaacaauuggcucugucucucuaaccauugcaacaauauguuuccuuaugcagauugccauccuaguaacgacuauaacacugcacuucaagcagaaugaaugcagcauucccucgaacaaucaaguggugccaugcgagccaaucauaguggaaaggaacauaacagagauaguguauuugaauaacaccaccauagaaaaagaacuuugcccuaaauuaacagaauacagggauuggucgaaaccacagugucagaucacaggguuugccccuuucuccaaggacaacucaauccgucuuucugcugguggggacauuuggguaacaagggaaccuuauguaucaugcagucccaauaaauguuaucaguucgcacuugggcagggaacuacgcuagacaacaaacacucaaauggcacaauacacgauaggauuccucaucgaacccuuuugaugaacgaguuggguguuccguuucauuuggggaccaaacaaguuugcauagcaugguccagcucaagcugucaugauggaaaagcauggcugcauguuuguguuacuggggaugauagaaaugcaaccgccaguuucauuuaugaugggaugcuuguugacaguauugguucauggucucaaaacauucucagaacucaggagucagaaugcgucugcaucaaugggacuuguacaguaguaaugacugauggaagugcaucaggaagggcugauacuagaauacuauucauuaaagaggggaaaauuguccaugucagcccauugucaggaagugcucagcauauagaggaauguuccuguuauccccgcuauccagaugucagauguguuugcagagacaauuggaaagguuccaauaggcccauuauagauauaaauguggcagauuauagcauugacucuaguuacguguguucagggcuuguuggagacacaccaagaaacgaugauagcucuagcaauagcaacugcaaggauccuaauaaugagagagggaacccuggaguaaaagggugggcauuugacuauggaaaugauguuuggaugggaagaacaaucagcaaggauucacgcucugguuaugagaccuucagggucauuggcgguuggacaacagcuaauuccaaaucucagguaaauagacaagucauaguugacaacaauaauuggucuggguauucuggcauuuucucuguugaaggcaaaagcugcaucaauagguguuuuuauguggaguugauaagaggaaggccacaagagacuagaguaugguggaccucaaacagcaucgucguauuuuguggaacuucagguacuuauggaacaggcucauggccugauggggcgaauaucaauuucaugccuauauaa

SEQ ID NO: 54095 - RNA, 1401 nt, Artificial Sequence
  neuraminidase__InfluenzaA__AGQ81814
augaauccaaaucagaagauaauagcaauuggcucuguuucucuaaccauugcgauaaugugcuuccucaugcagauugccaucuuaacaacgacuaugacacuacauuucaagcaaaaugaaugcagcaacccaucaaauaaucaaguggugccaugugaaccgauccuaauagagaggaacacagugcauuugaauaguacuaccauagagaaggaaguuuguccuaaaguggcagaauacaagaauuggucaaaaccacaaugucaaauuacaggguucgcuccuuucucaaaggacaacucaauuaggcuuucugcagguggagauaucuggguaacaagagaaccuuauguuucaugcagucuuggcaaauguuaucaauuugcacuugggcagggaaccacccugaaaaacaaucacucaaauggcaccacacaugauagaacuccucacagaacucuuuuaaugaaugaguuagguguuccauuucauuugggaaccaaacaagugugcauagcauggucuaguucaaguugcuaugauggaaaagcaugguuacauauuuguguuacuggggaugauaaaaaugcuacugcuaguaucauuuaugaugggaugcuugucgacaguauugguucaugguccaaaaacauccucagaacccaggagucagaaugcguuugcaucaauggaacuugugcaguaguaaugacugaugggagugcaucaggaaaggcugacacuagaauauuauucauaagagaggggaaaauuauaaacauuagcccauuaucagggagugcucagcauguugaggaaugcucauguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauagcuccagcagcagcaauugcagagacccuaauaacgaaagaggggccccaggagugaaaggaugggccuuugacgaugguaaugauguuuggaugggacgaacaaucagaaauaauucacgcucagguuaugagaccuuuaggguugucaacgguuggaccacggcuaauucaaagucacaaauaaauaggcaagucauaguugacagugaaaacuggucuggguauucugguaucuucucuguugaaggcaaaaacugcaucaacagguguuuuuauguggagcugauaagagggaggccacaggagcccagagugugguggacuucaaauagcaucauuguauucuguggaaccucagguacauaugggacaggcucauggccugauggagcgaauaucaacuucaugccuauauaa

SEQ ID NO: 54096 - RNA, 1401 nt, Artificial Sequence
  neuraminidase__InfluenzaA__AGQ81815
augaauccaaaucagaagauaauagcaauuggcucuguuucacuaaccauugcgauaauaugcuuccucaugcagauugccaucuuaacaacgacuaugacccuacauuucaagcaaaaugaaugcagcaacccaucaaauaaccaaguggugccaugugaaccgauccuaauagagaggaacacagugcauuugaauaguacuaccauagagaaggaaguuuguccuaaaguggcagaauacaagaauuggucaaaaccacaaugucaaauuacaggguucgcuccuuucucaaaggacaacucaauuaggcuuucugcagguggagauaucuggguaacaagagaaccuuauguuucaugcagucuuggcaaauguuaucaauuugcacuugggcagggaaccacccugaaaaacaagcacucaaauggcaccacacaugauagaacuccucacagaacucuuuuaaugaaugaguuaggugucccauuucauuugggaacaaaacaagugugcauagcauggucuaguucaaguugcuaugauggaaaagcaugguuacauauuuguguuacuggggaugauaaaaaugcuacugcuaguaucauuuaugaugggaugcuuguugacaguauugguucaugguccaagaacauccucagaacccaggagucagaaugcguuugcaucaauggaacuugugcaguaguaaugacugauggaagugcaucaggaaaggcugacacuagaauauuauucauaagagaggggaaaauuauaaacauuagcccauugucagggagugcucagcacguugaggaaugcuccuguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauagcuccagcagcagcaauugcagagauccuaauaacgaaagagggaccccaggagugaaaggaugggccuuugacgaugguaaugauguuuggaugggacgaacaaucagaaaugauucacgcucagguuaugagacuuuuaggguaaucaaugguuggaccacggcuaauucaaagucacaaauaaauaggcaagucauaguugacagugaaaacuggucuggguauucugguaucuucucuguugaaggcaaaaacugcaucaacagguguuuuuauguggaguugauaagagggagaccacaggagcccagagugugguggacuucaaauagcaucauuguauucuguggaaccucagguacauauggaacaggcucauggccugauggagcgaauaucaacuacaugccuauauaa

SEQ ID NO: 54097 - RNA, 1401 nt, Artificial Sequence
  neuraminidase__InfluenzaA__AGQ81816
augaauccaaaucagaagauaauagcaauuggcucuguuucacuaaccauugcgauaauaugcuuccucaugcagauugccaucuuaacaacgacuaugacccuacauuucaagcaaaauggaugcagcaacccaucaaauaaccaaguggugccaugugaaccgauccuaauagagaggaacacagugcauuugaauaguacuaccauagagaaggaaguuuguccuaaaguggcagaauacaagaauuggucaaaaccacaaugucaaauuacaggguucgcuccuuucucaaaggacaacucaauuaggcuuucugcagguggagauaucuggguaacaagagaaccuuauguuucaugcagucuuggcaaauguuaucaauuugcacuugggcagggaaccacccugaaaaacaagcacucaaauggcaccacacaugauagaacuccucacagaacucuuuuaaugaaugaguuaggugucccauuucauuugggaacaaaacaagugugcauagcauggucuaguucaaguugcuaugauggaaaagcaugguuacauauuuguguuacuggggaugauaaaaaugcuacugcuaguaucauuuaugaugggaugcuuguugacaguauugguucaugguccaagaacauccucagaacccaggagucagaaugcguuugcaucaauggaacuugugcaguaguaaugacugauggaagugcaucaggaaaggcugacacuagaauauuauucauaagagaggggaaaauuauaaacauuagcccauugucagggagugcucagcacguugaggaaugcuccuguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauagcuccagcagcagcaauugcagagauccuaauaacgaaagagggaccccaggagugaaaggaugggccuuugacgaugguaaugauguuuggaugggacgaacaaucagaaaugauucacgcucagguuaugagacuuuuaggguaaucaaugguuggaccacggcuaauucaaagucacaaauaaauaggcaagucauaguugacagugaaaacuggucuggguauucugguaucuucucuguugaaggcaaaaacugcaucaacagguguuuuuauguggaguugauaagagggagaccacaggagcccagagugugguggacuucaaauagcaucauuguauucuguggaaccucagguacauauggaacaggcucauggccugauggagcgaauaucaacuacaugccuauauaa

SEQ ID NO: 54098 - RNA, 1401 nt, Artificial Sequence; identical to SEQ ID NO: 54096
  neuraminidase__InfluenzaA__AGQ81817

SEQ ID NO: 54099 - RNA, 1401 nt, Artificial Sequence; identical to SEQ ID NO: 54096
  neuraminidase__InfluenzaA__AGQ81818

SEQ ID NO: 54100 - RNA, 1401 nt, Artificial Sequence
  neuraminidase__InfluenzaA__AGQ81819
augaauccaaaucagaagauaauagcaauuggcucuguuucacuaaccauugcgauaauaugcuuucucaugcagauugccaucuuaacaacgacuaugacccuacauuucaagcaaaaugaaugcagcaacccaucaaauaaccaaguggugccaugugaaccgauccuaauagagaggaacacagugcauuugaauaguacuaccauagagaaggaaguuuguccuaaaguggcagaauacaagaauuggucaaaaccacaaugucaaauuacaggguucgcuccuuucucaaaggacaacucaauuaggcuuucugcagguggagauaucuggguaacaagagaaccuuauguuucaugcagucuuggcaaauguuaucaauuugcacuugggcagggaaccacccugaaaaacaagcacucaaauggcaccacacaugauagaacuccucacagaacucuuuuaaugaaugaguuaggugucccauuucauuugggaacaaaacaagugugcauagcauggucuaguucaaguugcuaugauggaaaagcaugguuacauauuuguguuacuggggaugauaaaaaugcuacugcuaguaucauuuaugaugggaugcuuguugacaguauugguucaugguccaagaacauccucagaacccaggagucagaaugcguuugcaucaauggaacuugugcaguaguaaugacugauggaagugcaucaggaaaggcugacacuagaauauuauucauaagagaggggaaaauuauaaacauuagcccauugucagggagugcucagcacguugaggaaugcuccuguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauagcuccagcagcagcaauugcagagauccuaauaacgaaagagggaccccaggagugaaaggaugggccuuugacgaugguaaugauguuuggaugggacgaacaaucagaaaugauucacgcucagguuaugagacuuuuaggguaaucaaugguuggaccacggcuaauucaaagucacaaauaaauaggcaagucauaguugacagugaaaacuggucuggguauucugguaucuucucuguugaaggcaaaaacugcaucaacagguguuuuuauguggaguugauaagagggagaccacaggagcccagagugugguggacuucaaauagcaucauuguauucuguggaaccucagguacauauggaacaggcucauggccugauggagcgaauaucaacuacaugccuauauaa

SEQ ID NO: 54101 - RNA, 1401 nt, Artificial Sequence
  neuraminidase__InfluenzaA__AGQ81820
augaauccaaaucagaagauaauagcaauuggcucuguuucucuaaccauugcgauaauaugcuuccucaugcagauugccaucuuaacaacgacuaugacccuacauuucaagcaaaaugaaugcagcaacccaucaaauaaccaaguggugccaugugaaccgauccuaauagagaggaacacagugcauuugaauaguacuaccauagagaaggaaguuuguccuaaaguggcggaauacaagaauuggucaaaaccacaaugucaaauuacaggguucgcuccuuucucaaaggacaacucaauuaggcuuucugcagguggagauaucuggguaacaagagaaccuuauguuucaugcagucuuggcaaauguuaucaauuugcacuugggcagggaaccacccugaaaaacaagcacucaaauggcaccacacaugauagaacuccucacagaacucuuuuaaugaaugaguuaggugucccauuucauuugggaaccaaacaagugugcauagcauggucuaguucaaguugcuaugauggaaaagcaugguugcauauuuguguuacuggggaugauaaaaaugcuacugcuaguaucauuuaugaugggaugcuuguugacaguauugguucaugguccaaaaacauccucagaacccaggagucagaaugcguuugcaucaauggaacuugugcaguaguaaugacugauggaagugcaucaggaaaggcugacacuagaauauuauucauaagagaggggaaaauuauaaacauuagcccauugucagggagugcucagcacguugaggaaugcuccuguuacccccgguauccugaaguuagguguguuugcagagacaauuggaaaggcuccaauaggcccguucuauauauaaauauggcagauuauaguauugaguccaguuaugugugcucaggacuuguuggcgacacaccaagaaaugaugauagcuccagcagcagcaauugcagagacccuaauaacgaaagagggaccccaggagugaaaggaugggccuuugacgaugguaaugauguuuggaugggacgaacaaucagaaaugauucacgcucagguuaugagacuuuuaggguaaucaaugguuggaccacagcuaauucaaagucacaaauaaauaggcaagucauaguugacagugaaaacuggucuggguauucugguaucuucucuguugaaggcaaaaacugcaucaacagguguuuuuauguggaguugauaagagggagaccacaggagcccaaagugugguggacuucaaauagcaucauuguauucuguggaaccucagguacauauggaacaggcucauggccugauggagcgaauaucaacuucaugccuauauaa

SEQ ID NO: 54102 - RNA, 1401 nt, Artificial Sequence
  neuraminidase__InfluenzaA__AGQ81822
augaauccaaaucagaagauaauagcaauuggcucuguuucacuaaccauugcgauaauaugcuuccucaugcagauugccaucuuaacaacgacuaugacccuacauuucaagcaaaaugaaugcagcaacccaucaaauaaccaaguggugccaugugaaccgauccuaauagagaggaacacagugcauuugaauaguacuaccauagagaagaaaguuuguccuaaaguggcagaauacaagaauuggucaaaaccacaaugucaaauuacaggguucgcuccuuucucaaaggacaacucaauuaggcuuucugcagguggagauaucuggguaacaagagaaccuuauguuucaugcagucuuggcaaauguuaucaauuugcacuugggcagggaaccacccugaaaaacaagcacucaaauggcaccacacaugauagaacuccucacagaacucuuuuaaugaaugaguuaggugucccauuucauuugggaacaaaacaagugugcauagcauggucuaguucaaguugcuaugauggaaaagcaugguuacauauuuguguuacuggggaugauaaaaaugcuacugcuaguaucauuuaugaugggaugcuuguugacaguauugguucaugguccaagaacauccucagaacccaggagucagaaugcguuugcaucaauggaacuugugcaguaguaaugacugauggaagugcaucaggaaaggcugacacuagaauauuauucauaagagaggggaaaauuauaaacauuagcccauugucagggagugcucagcacguugaggaaugcuccuguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauagcuccagcagcagcaauugcagagauccuaauaacgaaagagggaccccaggagugaaaggaugggccuuugacgaugguaaugauguuuggaugggacgaacaaucagaaaugauucacgcucagguuaugagacuuuuaggguaaucaaugguuggaccacggcuaauucaaagucacaaauaaauaggcaagucauaguugacagugaaaacuggucuggguauucugguaucuucucuguugaaggcaaaaacugcaucaacagguguuuuuauguggaguugauaagagggagaccacaggagcccagagugugguggacuucaaauagcaucauuguauucuguggaaccucagguacauauggaacaggcucauggccugauggagcgaauaucaacuacaugccuauauaa

SEQ ID NO: 54103 - RNA, 1401 nt, Artificial Sequence
  neuraminidase__InfluenzaA__AGQ81823
augaauccaaaucagaagauaauagcaauuggcucuguuucucuaaccauugcgauaauaugcuuccucaugcagauugccaucuuaacaacgacuaugacacuacauuucaagcaaaaugaaugcagcaacccaucaaauaaucaaguggugccaugugaaccgauccuaauagagaggaacacagugcauuugaauaguacuaccauagagaaggaaguuuguccuaaaguggcagaauacaagaauuggucaaaaccacaaugucaaauuacaggguucgcuccuuucucaaaggacaacucaauuaggcuuucugcggguggagauaucuggguaacaagagaaccuuauguuucaugcagucuuggcaaauguuaucaauuugcacuugggcagggaaccacccugaaaaacaagcacucaaauggcaccacacaugauagaacuccucacagaacucuuuuaaugaaugaguuaggugucccauuucauuugggaaccaaacaagugugcauagcauggucuaguucaaguugcuaugauggaaaagcaugguuacauauuuguguuacuggggaugauaaaaaugcuacugcuaguaucauuuaugaugggaugcuuguugacaguauugguucaugguccaaaaacauccucagaacccaggagucagaaugcguuugcaucaauggaacuugugcaguaguaaugacugaugggagugcaucaggaaaggcugacacuagaauauuauucauaagagaggggaaaauuauaaacauuagcccauuaucagggagugcucagcacguugaggaaugcucauguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauagcuccagcagcagcaauugcagagacccuaauaacgaaagaggggccccaggagugaaaggaugggccuuugacgaugguaaugauguuuggaugggacgaacaaucagaaaugauucacgcucagguuaugagaccuuuaggguagucaaugguuggaccacggcuaauucaaagucacaaauaaauaggcaagucauaguugacagugaaaacuggucuggguauucugguaucuucucuguugaaggcaaaaacugcaucaacagguguuuuuauguggagcugauaagagggaggccacaggagcccagagugugguggacuucaaauagcaucauuguauucugugggaccucagguacauaugggacaggcucauggccugauggagcgaauaucaacuucaugccuauauaa

SEQ ID NO: 54104 - RNA, 1401 nt, Artificial Sequence
  neuraminidase__InfluenzaA__AGQ81824
augaauccaaaucagaagauaauagcaauuggcucuguuucucuaaccauugcgauaauaugcuuccucaugcagauugccaucuuaacaacgacuaugacacuacauuucaagcaaaaugaaugcagcaacccaucaaauaaucaaguggugccaugugaaccgauccuaauagagaggaacacagugcauuugaauaguacuaccauagagaaggaaguuuguccuaaaguggcagaauacaagaauuggucaaaaccacaaugucaaauuacaggguucgcuccuuucucaaaggacaacucaauuaggcuuucugcggguggagauaucuggguaacaagagaaccuuauguuucaugcagucuuggcaaauguuaucaauuugcacuugggcagggaaccacccugaaaaacaagcacucaaauggcaccacacaugauagaacuccucacagaacucuuuuaaugaaugaguuaggugucccauuucauuugggaaccaaacaagugugcauagcauggucuaguucaaguugcuaugauggaaaagcaugguuacauauuuguguuacuggggaugauaaaaaugcuacugcuaguaucauuuaugaugggaugcuuguugacaguauugguucaugguccaaaaacauccucagaacccaggagucagaaugcguuugcaucaacggaacuugugcaguaguaaugacugaugggagugcaucaggaaaggcugacacuagaauauuauucauaagagaggggaaaauuauaaacauuagcccauuaucagggagugcucagcacguugaggaaugcucauguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauagcuccagcagcagcaauugcagagacccuaauaacgaaagaggggccccaggagugaaaggaugggccuuugacgaugguaaugauguuuggaugggacgaacaaucagaaaugauucacgcucagguuaugagaccuuuaggguagucaaugguuggaccacggcuaauucaaagucacaaauaaauaggcaagucauaguugacagugaaaacuggucuggguauucugguaucuucucuguugaaggcaaaaacugcaucaacagguguuuuuauguggagcugauaagagggaggccacaggagcccagagugugguggacuucaaauagcaucauuguauucugugggaccucagguacauaugggacaggcucauggccugauggagcgaauaucaacuucaugccuauauaa

SEQ ID NO: 54105 - RNA, 1401 nt, Artificial Sequence; identical to SEQ ID NO: 54104
  neuraminidase__InfluenzaA__AGQ81825

SEQ ID NO: 54106 - RNA, 1401 nt, Artificial Sequence
  neuraminidase__InfluenzaA__AGQ81831
augaauccaaaucagaagauacuagcaauuggcucuguuucucuaaccauugcgauaauauguuuccucaugcagauugccaucuuaacaacgacuaugacccuacauuucaagcaaaaugaaugcagcaacccaucaaauaaucaaguggugccaugugaaccaauccuaauagagaggaacacagugcauuugaauaguacuaccauagagaaggaaguuuguccuaaaguggcagaauacaagaauuggucaaaaccacaaugucaaauuacuggguucgcuccuuucucaaaggacaacucaauuaggcuuucugcagguggagauaucuggguaacaagagagccuuauguuucaugcagucuuggcaaauguuaucaauuugcacuugggcagggaaccacccugaaaaacaagcacucaaauggcaccacacaugauaggacuccucacagaacucuuuuaaugaaugaauuaggugucccauuccauuugggaaccaaacaagugugcauagcauggucuaguucaaguugcuaugauggaaaagcaugguuacauauuuguguuacuggggacgauaaaaaugccacugcuaguaucauuuaugaugggaugcuuguugacaguauugguucaugguccaaaaacauccucagaacccaggagucagaaugcguuugcaucaauggaacuugugcaguaguaaugacugauggaagugcaucaggaaaggcugacacuagaauauuauucauaagggaggggaaaauuguaaacauuagcccauugucagggagugcucagcacguugaggaaugcuccuguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauagcuucagcagcagcaauugcagagacccuaauaacgaaagaggggccccaggagugaaaggaugggccuuugacgaugguaaugauguuuggaugggacgaacaaucagaaaugauucacgcucagguuaugagacuuuuaggguagucaaugguuggaccacggcuaauucaaagucacaaauaaauaggcaagucauaguugacagugaaagcuggucuggguauucugguaucuucucuguugaaggcaaaaacugcaucaacagguguuuuuauguggaguugauaagagggagaccacaggagccuagagugugguggacuucaaauagcaucauuguauucuguggaaccucagguacauauggaacaggcucauggccugauggagcgaauaucaacuucaugccuauauaa

SEQ ID NO: 54107 - RNA, 1401 nt, Artificial Sequence; identical to SEQ ID NO: 54096
  neuraminidase__InfluenzaA__AGQ81837

SEQ ID NO: 54108 - RNA, 1401 nt, Artificial Sequence; identical to SEQ ID NO: 54096
  neuraminidase__InfluenzaA__AGQ81838

SEQ ID NO: 54109 - RNA, 1401 nt, Artificial Sequence; identical to SEQ ID NO: 54103
  neuraminidase__InfluenzaA__AGQ81839

SEQ ID NO: 54110 - RNA, 1401 nt, Artificial Sequence; identical to SEQ ID NO: 54103
  neuraminidase__InfluenzaA__AGQ81840

SEQ ID NO: 54111 - RNA, 1401 nt, Artificial Sequence; identical to SEQ ID NO: 54100
  neuraminidase__InfluenzaA__AGQ81841

SEQ ID NO: 54112 - RNA, 1410 nt, Artificial Sequence
  neuraminidase__InfluenzaA__AGQ81843
augaauccaaaucagaagauaauaacaauugguguagugaacacgacucuaucaacaauagcccuucuuauuggaauugggaaucugauuuucaacacuguuauacaugagaaaauaggaguccaccaaacugugguauacccaacaauaacacccccagugauaccaaacugcagugacaccacaauuacauacaacaacacugugguaaacaacauaacaacaacaauaauaaacaaagcggaaaagcaguucaagcccucacugccacugugccccuuccgagguuucuucccuuuucauaaggacaaugcaauacgauugggugagaacaaagauguaauagucacaagagagccuuaugucaguugcgacaaugaugauugcugguccuuugcccuugcccaaggggcucuacuaggaacuaaacacagcaauggaaccaucaaagacaggacaccguauagaucauugauccgguuuccgauagggacagcuccagugcuggguaacuacaaggagauauguguugcuuggucaaguagcaguuguuucgauggaaaggaauggaugcauguuugcaugacuggaaaugacaaugaugcgaguggccaaauaauauaugcagggaagaugacagacuccauuaaaucauggagaagagauauauuaagaacucaagagucugaaugccaaugcauugaugggaccuguauugucgcugucacagauggcccugcagcuaguagugcagaccaccgaauuuacuggauacgagaagggaagauaauaaaguaugaagacauucccaaaacaaagauacagcauuuagaggaguguucuugcuauguggacaccgauguguacugcauauguagggacaauuggaaagguucuaacaggccuuggaugaggaucaacaaugagaccauacuagaaacaggguauguaugcagcaaauuccauucagacacccccaggccagccgauccuucaacagugucaugugauuccccaaguaacaucaauggaggaccuggagucaaaggauuuggcuucagagcggguaaugauguaugguugggaaggacaguaucaacuacuggaagaucaggcuuugaagucaucaaggucacagagggauggaucaacucccucaaucaugcuaaaucaguuacacaaacacuaguaucgaacaaugauuggucagguuacucagggaguuucauuguugagaacaauggcuguuuccagcccugcuucuacauugaacucauacggggaaggcccaauaggaacgacgacguuucuuggacaagcaauaguauaguuacuuucuguggacuagacaaugaaccuggaucgggaaauuggccugaugguuccaacauuggguuuaugcccaaguaa

SEQ ID NO: 54113 - RNA, 1410 nt, Artificial Sequence
  neuraminidase__InfluenzaA__AGQ81845
augaauccaaaucagaagauaauaacaauugguguaguaaacacgacucuaucaacaauagcccuucuuauuggaauugggaaucugauuuucaacacuguuauacaugagaaaauagggguccaccaaacugugauauacccaacaauaacauccccagugguaccaaacugcagugacaccacaauuacauacaacaacacugugguaaacaacauaacaacaacaguaauaaauaaagcggaaaagcauuucaagcccucacugccacugugccccuucaaagguuucuuccccuuucauaaggacaaugcaauacgauugggugagaacaaagauguaauagucacaagggagccuuaugucaguugcgacaaugaugauugcugguccuuugcccucgcccaaggggcucugcuaggaacuaaacacagcaauggaaccaucaaggacaggacaccguauagaucauuaauccgguucccaauagggacagccccaguacuggguaacuacaaggagauauguguugcuuggucaaguagcaguugcuucgauggaaaagaauggaugcauguuugcaugacuggaaaugacaaugaugcgaguggccaaauaauauaugcagggaagaugacagacuccauuaaaucauggagaagggauauacuaagaacucaagaauccgaaugucaaugcauugaugggaccuguauugucgcuguuacagauggcccugcagcuaauagugcagaucaccgaauuuacuggauacgagaaggaaagauaauaaaguaugaaaacauucccaaaacaaagauacaacauuuagaggaguguucuugcuauguggacaccgauguguacugcauauguagggacaauuggaaagguucuaacaggccuuggaugaggaucaacaaugagaccauacuagaaacaggguauguaugcagcaaauuccauucagauacccccaggccagccgauccuucaacagugucaugugauuccccaaguaacaucaauggaggaccuggagucaaaggauuugguuucagaacagguaaugauguaugguugggaaggacggugucaacuacuggaagaucaggcuuugaagucaucaaggucacagagggauggaucaacucccucaaucaugccaaaucaguuacacaaacacuaguaucgaacagugauuggucagguuacucagggaguuucauuguugagaacaauggcuguuuccagcccugcuucuauauugaacucauacggggaaggcccaauaagaacgaugauguuucuuggacaagcaauaguauaguuacuuucuguggacuagacaaugaaccuggaucgggaaauuggccugaugguuccaacauuggguuuaugcccaaguaa

SEQ ID NO: 54114 - RNA, 1410 nt, Artificial Sequence
  neuraminidase__InfluenzaA__AGQ81846
augaauccaaaucagaagauaauaacaauugguguaguaaacacgacucuaucaacaauagcccuucuuauuggaauugggaaucugauuuucaacacuguuauacaugagaaaauagggguccaccaaacugugauauacccaacaauaacauccccagugguaccaaacugcagugacaccacaauuacauacaacaacacugugguaaacaacauaacaacaacaguaauaaauaaagcggaaaagcauuucaagcccucacugccacugugccccuucaaagguuucuuccccuuucauaaggacaaugcaauacgauugggugagaacaaagauguaauagucacaagggagccuuaugucaguugcgacaaugaugauugcugguccuuugcccucgcccaaggggcucuacuaggaacuaaacacagcaauggaaccaucaaggacaggacaccguauagaucauuaauccgguucccaauagggacagccccaguacuggguaacuacaaggagauauguguugcuuggucaaguagcaguugcuucgauggaaaagaauggaugcauguuugcaugacuggaaaugacaaugaugcgaguggccaaauaauauaugcagggaagaugacagacuccauuaaaucauggagaagggauauacuaagaacucaagaauccgaaugucaaugcauugaugggaccuguauugucgcuguuacagauggcccugcagcuaauagugcagaucaccgaauuuacuggauacgagaaggaaagauaauaaaguaugaaaacauucccaaaacaaagauacaacauuuagaggaguguucuugcuauguggacaccgauguguacugcauauguagggacaauuggaaagguucuaacaggccuuggaugaggaucaacaaugagaccauacuagaaacaggguauguaugcagcaaauuccauucagauacccccaggccagccgauccuucaacagugucaugugauuccccaaguaacaucaauggaggaccuggagucaaaggauuugguuucagaacagguaaugauguaugguugggaaggacggugucaacuacuggaagaucaggcuuugaagucaucaaggucacagagggauggaucaacucccucaaucaugccaaaucaguuacacaaacacuaguaucgaacagugauuggucagguuacucagggaguuucauuguugagaacaauggcuguuuccagcccugcuucuauauugaacucauacggggaaggcccaauaagaacgaugaugucucuuggacaagcaauaguauaguuacuuucuguggacuagacaaugaaccuggaucgggaaauuggccugaugguuccaacauuggguuuaugcccaaguaa

SEQ ID NO: 54115 - RNA, 1410 nt, Artificial Sequence
  neuraminidase__InfluenzaA__AGQ81847
augaauccaaaucagaagauaauaacaauugguguaguaaacacgacucugucaacaauagcccuucuuauuggaauugggaaucugauuuucaacacuguuauacaugagaaaauagggguccaccaaacugugauauacccaacaauaacauccccagugguaccaaacugcagugacaccacaauuacauacaacaacacugugguaaacaacauaacaacaacaguaauaaauaaagcggaaaagcauuucaagcccucacugccacugugccccuucaaagguuucuuccccuuucauaaggacaaugcaauacgauugggugagaacaaagauguaauagucacaagggagccuuaugucaguugcgacaaugaugauugcugguccuuugcccucgcucaaggggcucuacuaggaacuaaacacagcaauggaaccaucaaggacaggacaccguauagaucauuaauccgguucccaauagggacagccccaguacuggguaacuacaaggagauauguguugcuuggucaaguagcaguugcuucgauggaaaagaauggaugcauguuugcaugacuggaaaugacaaugaugcgaguggccaaauaauauaugcagggaagaugacagacuccauuaaaucauggagaagggauauacuaagaacucaagaauccgaaugucaaugcauugaugggaccuguauugucgcuguuacagauggcccugcagcuaauagugcagaucaccgaauuuacuggauacgagaaggaaagauaauaaaguaugaaaacauucccaaaacaaagauacaacauuuagaggaguguucuugcuauguggacaccgauguguacugcauauguagggacaauuggaaagguucuaacaggccuuggaugaggaucaacaaugagaccauacuagaaacaggguauguaugcagcaaauuccauucagauacccccaggccagccgauccuucaacagugucaugugauuccccaaguaacaucaauggaggaccuggagucaaaggauuugguuucagaacagguaaugauguaugguugggaaggacggugucaacuacuggaagaucaggcuuugaagucaucaaggucacagagggauggaucaacucccucaaucaugccaaaucaguuacacaaacacuaguaucgaacagugauuggucagguuacucagggaguuucauuguugagaacaauggcuguuuccagcccugcuucuauauugaacucauacggggaaggcccaauaagaacgaugaugucucuuggacaagcaauaguauaguuacuuucuguggacuagacaaugaaccuggaucgggaaauuggccugaugguuccaacauuggguuuaugcccaaguaa

SEQ ID NO: 54116 - RNA, 1410 nt, Artificial Sequence
  neuraminidase__InfluenzaA__AGQ81848
augaauccaaaucagaagauaauaacaauugguguaguaaacacgacucugucaacaauagcccuucuuauuggaauugggaaucugauuuucaacacuguuauacaugagaaaauagggguccaccaaacugugauauacccaacaauaacauccccagugguaccaaacugcagugacaccacaauuacauacaacaacacugugguaaacaacauaacaacaacaguaauaaauaaagcggaaaagcauuucaagcccucacugccacugugccccuucaaagguuucuuccccuuucauaaggacaaugcaauacgauugggugagaacaaagauguaauagucacaagggagccuuaugucaguugcgacaaugaugauugcugguccuuugcccucgcucaaggggcucuacuaggaacuaaacacagcaauggaaccaucaaggacaggacaccguauagaucauuaauccgguucccaauagggacagccccaguacuggguaacuacaaggagauauguguugcuuggucaaguagcaguugcuucgauggaaaagaauggaugcauguuugcaugacuggaaaugacaaugaugcgaguggccaaauaauauaugcagggaagaugacagacuccauuaaaucauggagaagggauauacuaagaacucaagaauccgaaugucaaugcauugaugggaucuguauugucgcuguuacagauggcccugcagcuaauagugcagaucaccgaauuuacuggauacgagaaggaaagauaauaaaguaugaaaacauucccaaaacaaagauacaacauuuagaggaguguucuugcuauguggacaccgauguguacugcauauguagggacaauuggaaagguucuaacaggccuuggaugaggaucaacaaugagaccauacuagaaacaggguauguaugcagcaaauuccauucagauacccccaggccagccgauccuucaacagugucaugugauuccccaaguaacaucaauggaggaccuggagucaaaggauuugguuucagaacagguaaugauguaugguugggaaggacggugucaacuacuggaagaucaggcuuugaagucaucaaggucacagagggauggaucaacucccucaaucaugccaaaucaguuacacaaacacuaguaucgaacagugauuggucagguuacucagggaguuucauuguugagaacaauggcuguuuccagcccugcuucuauauugaacucauacggggaaggcccaauaagaacgaugaugucucuuggacaagcaauaguauaguuacuuucuguggacuagacaaugaaccuggaucgggaaauuggccugaugguuccaacauuggguuuaugcccaaguaa

SEQ ID NO: 54117 - RNA, 1410 nt, Artificial Sequence
  neuraminidase__InfluenzaA__AGQ81850
augaauccaaaucagaagauaauaacaauugguguaguaaacacgacucugucaacaauagcccuucuuauuggaauugggaaucugauuuucaauacuguuauacaugagaaaauagggguccaccaaacugugauauacccaacaauaacauccccagugguaccaaacugcagugacaccacaauuacauacaacaacacugugguaaacaacauaacaacaacaguaauaaauaaagcggaaaagcauuucaagcccucacugccacugugccccuucaaagguuucuuccccuuucauaaggacaaugcaauacgauugggugagaacaaagauguaauagucacaagggagccuuaugucaguugcgacaaugaugauugcugguccuuugcccucgcucaaggggcucuacuaggaacuaaacacagcaauggaaccaucaaggacaggacaccguauagaucauuaauccgguucccaauagggacagccccaguacuggguaacuacaaggagauauguguugcuuggucaaguagcaguugcuucgauggaaaagaauggaugcauguuugcaugacuggaaaugacaaugaugcgacuggccaaauaauauaugcagggaagaugacagacuccauuaaaucauggagaagggauauacuaagaacucaagaauccgaaugucaaugcauugaugggaccuguauugucgcuguuacagauggcccugcagcuaauagugcagaucaccgaauuuacuggauacgagaaggaaagauaauaaaguaugaaaacauucccaaaacaaagauacaacauuuagaggaguguucuugcuauguggacaccgauguguacugcauauguagggacaauuggaaagguucuaacaggccuuggaugaggaucaacaaugagaccauacuagaaacaggguauguaugcagcaaauuccauucagauacccccaggccagccgauccuucaacagugucaugugauuccccaaguaacaucaauggaggaccuggagucaaaggauuugguuucagaacagguaaugauguaugguugggaaggacggugucaacuacuggaagaucaggcuuugaagucaucaaggucacagagggauggaucaacucccucaaucaugccaaaucaguuacacaaacacuaguaucgaacagugauuggucagguuacucagggaguuucauuguugagaacaauggcuguuuccagcccugcuucuauauugaacucauacggggaaggcccaauaagaacgaugaugucucuuggacaagcaauagcauaguuacuuucuguggacuagacaaugaaccuggaucgggaaauuggccugaugguuccaacauuggguuuaugcccaaguaa

SEQ ID NO: 54118 - RNA, 1410 nt, Artificial Sequence
  neuraminidase__InfluenzaA__AGQ81852
augaauccaaaucagaagauaauaacaauugguguaguaaacacgacucugucaacaauagcccuucuuauuggaauugggaaucugauuuucaauacuguuauacaugagaaaauagggguccaccaaacugugacauacccaacaauaacauccccagugguaccaaacugcagugacaccacaauuacauacaacaacacugugguaaacaacauaacaacaacaguaauaaauaaagcggaaaagcauuucaagcccucacugccacugugccccuucaaagguuucuuccccuuucauaaggacaaugcaauacgauugggugagaacaaagauguaauagucacaagggagccuuaugucaguugcgacaaugaugauugcugguccuuugcccucgcucaaggggcucuacuagggacuaaacacagcaauggaaccaucaaggacaggacaccguauagaucauuaauccgguucccaauagggacagccccaguacuggguaacuacaaggagauauguguugcuuggucaaguagcaguugcuucgauggaaaagaauggaugcauguuugcaugacuggaaaugacaaugaugcgacuggccaaauaauauaugcagggaagaugacagacuccauuaaaucauggagaagggauauacuaagaacucaagaauccgaaugucaaugcauugaugggaccuguauugucgcuguuacagauggcccugcagcuaauagugcagaucaccgaauuuacuggauacgagaaggaaagauaauaaaguaugaaaacauucccaaaacaaagauacaacauuuagaggaguguucuugcuauguggacaccgauguguacugcauauguagggacaauuggaaagguucuaacaggccuuggaugaggaucaacaaugagaccauacuagaaacaggguauguaugcagcaaauuccauucagauacccccaggccagccgauccuucaacagugucaugugauuccccaaguaacaucaauggaggaccuggagucaaaggauuugguuucagaacagguaaugauguaugguugggaaggacggugucaacuacuggaagaucaggcuuugaagucaucaaggucacagagggauggaucaacucccucaaucaugccaaaucaguuacacaaacacuaguaucgaacagugauuggucagguuacucagggaguuucauuguugagaacaauggcuguuuccagcccugcuucuauauugaacucauacggggaaggcccaauaggaacgaugaugucucuuggacaagcaauagcauaguuacuuucuguggacuagacaaugaaccuggaucgggaaauuggccugaugguuccaacauuggguuuaugcccaaguaa

SEQ ID NO: 54119 - RNA, 1410 nt, Artificial Sequence
  neuraminidase__InfluenzaA__AGQ81853
augaauccaaaucagaagauaauaacaauugguguaguaaacacgacucugucaacaauagcccuucuuauuggaauugggaaucugauuuucaauacuguuauacaugagaaaauagggguccaccaaacugugacauacccaacaauaacauccccagugguaccaaacugcagugacaccacaauuacauacaacaacacugugguaaacaacauaacaacaacaguaauaaauaaagcggaaaagcauuucaagcccucacugccacugugccccuucaaagguuucuuccccuuucauaaggacaaugcaauacgauugggugagaacaaagauguaauagucacaagggagccuuaugucaguugcgacaaugaugauugcugguccuuugcccucgcucaaggggcucuacuagggacuaaacacagcaauggaaccaucaaggacaggacaccguauagaucauuaauccgguucccaauagggacagccccaguacuggguaacuacaaggagauauguguugcuuggucaaguagcaguugcuucgauggaaaagaauggaugcauguuugcaugacuggaaaugacaaugaugcgacuggccaaauaauauaugcagggaagaugacagacuccauuaaaucauggagaagggauauacuaagaacucaagaauccgaaugucaaugcauugaugggacuuguauugucgcuguuacagauggcccugcagcuaauagugcagaucaccgaauuuacuggauacgagaaggaaagauaauaaaguaugaaaacauucccaaaacaaagauacaacauuuagaggaguguucuugcuauguggacaccgauguguacugcauauguagggacaauuggaaagguucuaacaggccuuggaugaggaucaacaaugagaccauacuagaaacaggguauguaugcagcaaauuccauucagauacccccaggccagccgauccuucaacagugucaugugauuccccaaguaacaucaauggaggaccuggagucaaaggauuugguuucagaacagguaaugauguaugguugggaaggacggugucaacuacuggaagaucaggcuuugaagucaucaaggucacagagggauggaucaacucccucaaucaugccaaaucaguuacacaaacacuaguaucuaacagugauuggucagguuacucagggaguuucauuguugagaacaauggcuguuuccagcccugcuucuauauugaacucauacggggaaggcccaauaagaacgaugaugucucuuggacaagcaauagcauaguuacuuucuguggacuagacaaugaaccuggaucgggaaauuggccugaugguuccaacauuggguuuaugcccaaguaa

SEQ ID NO: 54120 - RNA, 1410 nt, Artificial Sequence
  neuraminidase__InfluenzaA__AGQ81854
augaauccaaaucagaagauaauaacaauugguguaguaaacacgacucugucaacaauagcccuucuuauuggaauugggaaucugauuuucaauacuguuauacaugagaaaauagggguccaccaaacugugacauacccaacaauaacauccccagugguaccaaacugcagugacaccacaauuacauacaacaacacugugguaaacaacauaacaacaacaguaauaaauaaagcggaaaagcauuucaagcccucacugccacugugccccuucaaagguuucuuccccuuucauaaggacaaugcaauacgauugggugagaacaaagauguaauagucacaagggagccuuaugucaguugcgacaaugaugauugcugguccuuugcccucgcucaaggggcucuacuagggacuaaacacagcaauggaaccaucaaggacaggacgccguauagaucauuaauccgguucccaauagggacagccccaguacuggguaacuacaaggagauauguguugcuuggucaaguagcaguugcuucgauggaaaagaauggaugcauguuugcaugacuggaaaugacaaugaugcgacuggccaaauaauauaugcagggaagaugacagacuccauuaaaucauggagaagggauauacuaagaacucaagaauccgaaugucaaugcauugaugggaccuguauugucgcuguuacagauggcccugcagcuaauagugcagaucaccgaauuuacuggauacgagaaggaaagauaauaaaguaugaaaacauucccaaaacaaagauacaacauuuagaggaguguucuugcuauguggacaccgauguguacugcauauguagggacaauuggaaagguucuaacaggccuuggaugaggaucaacaaugagaccauacuagaaacaggguauguaugcagcaaauuccauucagauacccccaggccagccgauccuucaacagugucaugugauuccccaaguaacaucaauggaggaccuggagucaaaggauuugguuucagaacagguaaugauguaugguugggaaggacggugucaacuacuggaagaucaggcuuugaagucaucaaggucacagagggauggaucaacucccucaaucaugccaaaucaguuacacaaacacuaguaucgaacagugauuggucagguuacucagggaguuucauuguugagaacaauggcuguuuccagcccugcuucuauauugaacucauacggggaaggcccaauaagaacgaugaugucucuuggacaagcaauagcauaguuacuuucuguggacuagacaaugaaccuggaucgggaaauuggccugaugguuccaacauuggguuuaugcccaaguaa

SEQ ID NO: 54121 - RNA, 1410 nt, Artificial Sequence; identical to SEQ ID NO: 54119
  neuraminidase__InfluenzaA__AGQ81855

SEQ ID NO: 54122 - RNA, 1410 nt, Artificial Sequence; identical to SEQ ID NO: 54112
  neuraminidase__InfluenzaA__AGQ81856

SEQ ID NO: 54123 - RNA, 1410 nt, Artificial Sequence
  neuraminidase__InfluenzaA__AGQ81857
augaauccaaaucagaagauaauaacaauugguguagugaacacgacucuaucaacaauagcccuucuuauuggaauugggaaucugauuuucaacacuguuauacaugagaaaauaggaguccaccaaacugugguauacccaacaauaacacccccagugauaccaaacugcagugacaccacaauuacauacaacaacacugugguaaacaacauaacaacaacaauaauaaacaaagcggaaaagcaguucaagcccucacugccacugugccccuuccgagguuucuucccuuuucauaaggacaaugcaauacgauugggugagaacaaagauguaauagucacaagagagccuuaugucaguugcgacaaugaugauugcugguccuuugcccuugcccaaggggcucuacuaggaacuaaacacagcaauggaaccaucaaagacaggacaccguauagaucauugauccgguuuccgauagggacagcuccagugcuggguaacuacaaggagauauguguugcuuggucaaguagcaguuguuucgauggaaaggaauggaugcauguuugcaugacuggaaaugacaaugaugcgaguggccaaauaauauaugcagggaagaugacagacuccauuaaaucauggagaagagauauauuaagaacucaagagucugaaugccaaugcauugaugggaccuguauugucgcugucacagauggcccugcagcuaguagugcagaccaccgaauuuacuggauacgagaagggaagauaauaaaguaugaagacauucccaaaacaaagauacagcauuuagaggaguguucuugcuauguggacaccgauguguacugcauauguagggacaauuggaaagguucuaacaggccuuggaugaggaucaacaaugagaccauacuagaaacaggguauguaugcagcaaauuccauucagacacccccaggccagccgauccuucaacagugucaugugauuccccaaguaacaucaauggaggaccuggagucaaaggauuuggcuucagagcggguaaugauguaugguugggaaggacaguaucaacuacuggaagaucaggcuuugaagucaucaaggucacagagggauggaucaacucccucaaucaugcuaaaucaguuacacaaacacuaguaucgaacaaugauuggucagguuacucagggaguuucauuguugagagcaauggcuguuuccagcccugcuucuacauugaacucauacggggaaggcccaauaggaacgacgacguuucuuggacaagcaauaguauaguuacuuucuguggacuagacaaugaaccuggaucgggaaauuggccugaugguuccaacauuggguuuaugcccaaguaa

SEQ ID NO: 54124 - RNA, 1410 nt, Artificial Sequence
  neuraminidase__InfluenzaA__AGQ81858
augaauccaaaucagaagauaaucacaauugguguagugaauacuacucuaucaacaauagcccuucuuauuggaguugggaaucugauuuucaacacuguuauacaugagaaaauaggggaccaucaaauugugguguauccaacaacaacagccucgguggugccaaacugcagugacaccauaauaacauacaauaacacugugguaaacaacauaacaacaacaauaauaacuaaagaggaaacgcacuucaaguccucacugccacugugucccuuccgagguuucuuccccuuucacaaggacaaugcaauacgauugggugagaacaaagacguaauagucacaagggagccuuaugucaguugugacaaugaugauugcugguccuuugcucucgcccagggggcucuacuggggacuaaacacagcaauggaaccaucaaagacaggacaccguauagaucauuaauccgguucccaauagggacugcuccuguacuggguaauuacaaggagauauguguugcuuggucaaguagcaguugcuucgauggaaaggaguggaugcauguuugcaugacugggaacgacaaugaugcgaguggccaaauaauguaugcagggaaaaugacagacuccauuaaaucauggagaaaggauauacuaagaacucaagagucugaaugucaaugcauugaugggaccuguauugucgcugucacagaugguccugcgacuaauagugcagaccaccgaauuuacuggauacgagaagggaagauaauaaaguaugagaacauucccaagacaaagauacaacauuuggaggaguguucuuguuauguggacaucgauguguacugcguauguagggacaauuggaaagguuccaacagaccuuggaugaggaucaacaaugagaccauauuagaaacaggguauguauguaguaaauuucauucagauacccccaggccagccgauccuucaacaguaucaugugauucuccaaguaacgucaauggaggaccuggagucaaagguuuuggcuucaaaacggguaaugauguaugguugggaaggacuguaucaacuaguggaagaucaggcuuugaaauuaucaaagucacggagggguggauuaacucccccaaucaugccaaaucaguuacacaaacauuagugucaaacaaugauuggucagguuacucagggaguuucauuguugagaacaauggcuguuuucagcccugcuucuauauugaacuuauacgggggaggcccaauaagaaugaugacguuucuuggacaagcaauaguauaguuacuuucuguggacuagacaaugaaccuggaucgggaaauuggccugaugguuccaacauuggguuuaugcccaaguaa

SEQ ID NO: 54125 - RNA, 1410 nt, Artificial Sequence
  neuraminidase__InfluenzaA__AGQ81859
augaauccaaaucagaagauaauaacaauugguguagugaauacgacucuaucaacaauagcccuucuuauuggaauugggaaucugauuuucaacacuguuauacaugagaaaauaggaguccaccaaacugugguaugcccaacaauaacacccccggugguaccaaacugcagugacaccacaauuacauacaacaacacugugguaaacaacauaacaacaacaauaauaaauaaagcggaaaagcaguucaaguccucacugccacugugucccuuccgagguuucuuccccuuccauaaggacaaugcaauacgauugggugagaacaaagauguaauagucacaagggagccuuaugucaguugcgacaaugaugauugcugguccuuugcccuugcccaaggggcucuacuaggaacuaaacacagcaauggaaccaucaaagauagaacaccguauagaucauugauucgguuuccaauagggacagcuccagugcuggguaacuacaaggagauaugcguugcuuggucaaguagcaguuguuucgauggaaaggaauggaugcauauuugcaugacuggaaaugacaaugaugcgaguggccagauaauauaugcaggcaagaugacagacuccauuaaaucauggagaagagauauauuaagaacucaagagucugaaugucaaugcauugaugggaccuguauugucgcuaucacagauggcccugcagcuaguagugcagaccaccgaauuuacuggauacgagaagggaagauaauaaaguaugaaaacauucccaaaacaaagauacaacauuuagaagaguguucuugcuauguggacaucgauguguacugcauauguagggauaauuggaaagguucuaacaggcccuggaugaggaucaacaaugagaccauacuagaaacaggguauguaugcagcaaauuccauucagacacccccaggccagccgaucccucaacagugucaugugauuccccaaguaacaucaauggaggaccuggagucaaaggauuuggcuucagagcggguaaugauguaugguugggaaggacaguaucaacuacuggaagaucaggcuuugaagucaucaaggucacagaaggauggaucaauucccucaaccaugcuaaaucaguuacacaaacacuaguaucgaacagugauuggucagguuacucagggaguuucauuguugaaaauaauggcuguuuccagcccugcuucuauaucgaacucauacggggaaggcccaauaggaacgaugauguuucuuggacaagcaauaguauaguuacuuucuguggacuagacaaugaaccuggaucgggaaauuggccugaugguuccaacauuggguuuaugcccaaguaa

SEQ ID NO: 54126 - RNA, 1413 nt, Artificial Sequence
  neuraminidase__InfluenzaA__AGQ81860
augaauccaaaucaaaagauaauaugcauuucagccacaggaaugacacuaucgguaguaagccugcugauaggaauugccaauuugggccuaaacaucggacuccauuauaaggugggugauacaccagaugugagcaucccaaacaugaaugagaccaacucaacaacaacaauaauaaacaauaauacccaaaauaauuucacaaauaucacuaacauuauagugaacaaaaacgaggaaaaaacguuccuaaaucugaccaagccccuaugugagguaaacucauggcacaucuugucgaaagacaaugcaauaagaauaggagaggaugcucauauacuagucacaagggagcccuaccugucuugcgauccacaaggcugcaggauguuugcucugagccaaggaacaacacucagagggcgacaugcgaaugggacuauacaugauagaagcccauuucgagcucucgugaguugggagaugggucaagcgcccaguccauacaauguuaaggucgaaugcguaggauggucgagcacaucgugccaugauggcauaucaagaaugucaauaugcaugucgggaccgaacaacaaugcaucagcagugguuugguacggggggaggccaguaacagaaauuccaucaugggcaggaaauauucucagaacccaagagucagaauguguaugccauaaagggaucuguccaguagucaugacggauggcccagcaaacaacagagcagcaacuaagauaaucuauuucaaagagggaaagauacagaaaauugaagaacuggcagggagugcccagcacaucgaagaauguucaugcuauggggcagucgaggugaucaaaugcauaugcagagacaauuggaaaggggcaaauagaccaguaauuacuauaaacccugaaaugaugacccacacgagcaaguauuugugcucgaagguccuaaccgauacaagucgccccaaugaucccacuaaugggaacugugaugcgccaauaacaggagggagcccugauccuggagugaagggguuugcguuccuagauggggaaaauucauggcuuggaaggacaauuagcaaagacuccaggucgggcuacgaaauguugaaagucccaaaugcagagaccgacacccaaucagggccgacaucacaccaaguaauugucaacaaccaaaacuggucgggauacucaggggcuuucauagacuacugggcaaacaaagagugcuucaauccuuguuuuuauguggaacuaaucagagggagacccaaggagaguaguguacuguggacuucaaauagcauuguagcucucuguggauccaaagagcgauugggaucaugguccuggcaugauggugcugaaaucaucuacuuuaaguag

SEQ ID NO: 54127 - RNA, 1413 nt, Artificial Sequence
  neuraminidase__InfluenzaA__AGQ81861
augaauccaaaucaaaagauaauaugcauuucagccacaggaaugacacuaucgguaguaagccugcugauaggaauugccaauuugggccuaaacaucggacuccauuauaaggugggugauacaccagaugugagcaucccaaacaugaaugagaccaacucaacaacaacaauaauaaacaauaauacccaaaauaauuucacaaauaccacuaacauuauagugaacaaaaacgaggaaaaaacguuccuaaaucugaccaagccccuaugugagguaaacucauggcacaucuugucgaaagacaaugcaauaagaauaggagaggaugcucauauacuagucacaagggagcccuaccugucuugcgauccacaaggcugcaggauguuugcucugagccaaggaacaacacucagagggcgacaugcgaaugggacuauacaugauagaagcccauuucgagcucucgugaguugggagaugggucaagcgcccaguccauacaauguuaaggucgaaugcguaggauggucgagcacaucgugccaugauggcauaucaagaaugucaauaugcaugucgggaccgaacaacaaugcaucagcagugguuugguacggggggaggccaguaacagaaauuccaucaugggcaggaaauauucucagaacccaagagucagaauguguaugccauaaagggaucuguccaguagucaugacggauggcccagcaaacaacagagcagcaacuaagauaaucuauuucaaagagggaaagauacagaaaauugaagaacuggcagggagugcccagcacaucgaagaauguucaugcuauggggcagucgaggugaucaaaugcauaugcagagacaauuggaaaggggcaaauagaccaguaauuacuauaaacccugaaaugaugacccacacgagcaaguauuugugcucgaagguccuaaccgauacaagucgccccaaugaucccacuaaugggaacugugaugcgccaauaacaggagggagcccugauccuggagugaagggguuugcguuccuagauggggaaaauucauggcuuggaaggacaauuagcaaagacuccaggucgggcuacgaaauguugaaagucccaaaugcagagaccgacacccaaucagggccgacaucacaccaaguaauugucaacaaccaaaacuggucgggauacucaggggcuuucauagacuacugggcaaacaaagagugcuucaauccuuguuuuuauguggaacuaaucagagggagacccaaggagaguaguguacuguggacuucaaauagcauuguagcucucuguggauccaaagagcgauugggaucaugguccuggcaugauggugcugaaaucaucuacuuuaaguag

SEQ ID NO: 54128 - RNA, 1413 nt, Artificial Sequence
  neuraminidase__InfluenzaA__AGQ81862
augaauccaaaucagaagauaauaugcauuucagccacaggaaugacacuaucgguaguaagccugcugauaggaauugccaauuuaggccuaaacaucggacuccauuauaaggugggugauacaccagaugugaacaucccaagcaugaacgaaaccaacucaacaacaacaauaauaaacaauaauacucaaaauaauuucacaaauaucacuaacauuauagugaacaaagaggagggaagaacauuucuaaaucugacuaagccucuaugugagguaaacucauggcacauucugucgaaagacaaugcaauaagaauaggggaggaugcucauauacuagucacaagggagcccuauuuguccugugauccgcaaggcuguaggauguuugcucugagccaaggcacaacacucagggggcgacaugcgaacggaacuauacaugacagaagcccauuccgagcucucgugagcugggagaugggucaagcgcccaguccauacaauguuagggucgaaugcauaggauggucaagcacaucaugccacgauggcauaucaagaaugucgauaugcaugucggggccgaacaacaaugcaucagcaguggucugguacggggguaggccaguaacagaaaucccaucaugggcaggaaauauucucagaacucaggaaucagaaugcgugugccauaaagggaucuguccaguggucaugacagauggcccagcaaacaauagagcagcaacuaagauaaucuauuucaaagagggaaagauacaaaaaauugaagaacuggaagggaaugcccaacacauugaagaauguucaugcuauggggcagcagggguaaucaaauguauaugcagggacaauuggaaaggggcaaauagaccaguaaucauuauagauccugaaaugaugacucacacaagcaaguauuugugcucaaggguacuaaccgauacaagucgccccaaugaucccacuagcgggaacugugaugcgccgauaacaggggggagcccagauccuggagugaagggguuugcauucuuggacggagagaacucauggcucggaaggacaauuaguaaagacuccagaucaggcuacgaaauguuaaaggucccaaaugcagaaacugauacccagucagggccaacaucacaccagguaauugucaacaaccaaaacuggucgggauacucaggggcauucauagacuauugggcaaacaaagaaugcuucaauccuuguuuuuauguggaauuaaucagagggagacccaaggagaguaguguacuguggacuucaaauagcauuguagcucucuguggauccaaagagcgauugggaucaugguccuggcacgauggugcugagaucaucuacuuuaaguag

SEQ ID NO: 54129 - RNA, 1413 nt, Artificial Sequence
  neuraminidase__InfluenzaA__AGQ81863
augaauccaaaucagaagauaauaugcauuucagccacaggaaugacacuaucgguaguaagccugcugauaggaaucgccaauuuaggccuaaacaucggacuccauuauaaggugggugauacaccagaugugaacauuccaagcaugaacgaaaccaacucaacgacaacaauaauaaacaauaauacucaaaauaauuucacaaauaucacuaacauuauagugaacaaagaggaggaaagaacauuucuaaaucugacuaagccucuaugugagguaaacucauggcacauucugucaaaagacaaugcaauaaggauaggggaggacgcucauauacuaguaacaagggagcccuauuuguccugugauccgcaaggcuguaggauguuugcucugagccaaggcacaacacucagagggcgacaugcaaacggaacuauacaugauagaagcccauuccgagcucuugugagcugggagaugggucaagcgcccaguccauauaauguuagggucgaaugcauaggauggucaagcacaucaugccacgauggaauaucaagaaugucgauaugcaugucagggccgaacaacaaugcaucagcaguggucugguacggggguaggccaguaacagagaucccaucaugggcaggaaauauucucagaacucaggaaucagaaugugugugccauaaagggaucuguccaguagucaugacagauggcccagcaaacaauagagcagcaacuaagauaaucuacuucaaagagggaaagauacagaaaaucgaagaacuggaagggaaugcccaacacaucgaagaauguucaugcuauggggcagcagggguaaucaaauguauaugcagagacaacuggaaaggggcaaauagaccaguaaucauuauagauccagaaaugaugacucacacaagcaaguacuugugcucaaggguacuaaccgauacaagucgccccaaugaucccauuagugggaacugugaugcuccgauaacagggggaagcccagauccuggggugaagggguuugcauucuuagauggagagaacucauggcucggaaggacaauuagcaaagacuccagaucaggcuacgaaauguuaaaggucccaaaugcagaaacugauacccaaucagguccaacaucgcaccagguaauugucaacaaccaaaacuggucgggauacucaggggcguucauagacuauugggcaaacaaagagugcuucaauccuuguuuuuauguggaacugaucagagggagacccaaggagaguaguguacuguggacuucaaauagcauuguagcucucuguggauccaaagagcgauugggaucaugguccuggcaugauggugcugagaucaucuacuuuaaguag

SEQ ID NO: 54130 - RNA, 1416 nt, Artificial Sequence
  neuraminidase__InfluenzaA__AGQ81864
augaauccaaaucagaaacuauuugcauuaucuggaguggcaauagcacuuaguguacugaacuuauugauaggaaucucaaaugucggguugaauguaucucuacaucuaaaggaaaaaggacccaagcaagaagaaaauucgacaugcacgaccauuaaucaaaacaacacuacuauuguggaaaacacauaugugaacaauacaacaauaauuuccaaggaaacugaguuaaaaccaccaaacuaccuacuguugaacaagagccuaugcaauguugaaggaugggucgugauagcgaaagacaaugcaguaagauucggggaaagugaacaaaucauuguuaccagagagccguacguaucaugcgauccaacaggaugcaaaauguaugccuugcaccaagggaccaccauuaggaacaaacauucaaauggaacaauccaugacagaacagcuuucagaggucucauuuccacuccauugggcacuccaccaaccguaaguaacagugacuucauauguguuggauggucaagcacaacuugccaugaugggauugguagaaugacuaucugcauacaaggaaauaaugacaacgcuacagcaacaguuuauuauaacagaaggcugacuacuaccauuaagaccugggcuagaaacauucugaggacucaagagucagaaugugugugccacaaugguacaugugcaguuguaaugacugacggaucggcuaguagucaagccuauacaaaaguaauguauuuccacaagggguuaguaauuaaggaagaggcauuaaagggaucagccagacacauugaggaaugcuccuguuacggacacagucaaaaggcaaccugugugugcagggauaauuggcagggagcaaauaggcccauuauagaaauugauaugaacacauuagagcacacaaguagauacgugugcacuggaauucucacagacaccagcagaccuggggacaagucuaguggcgauuguuccaauccaauaacuggaaguccuggcgcuccgggagugaagggauucggguuuuuaaauggggauaacacauggcuggguaggaccaucagccccaaaucaagaaguggauucgaaauguugaaaauaccuaaugcagguacugaucccaauucuagaauagcagaaaggcaggaaauugucgacaauaacaauuggucaggcuauuccggaagcuuuauugacuauugggauaaugacagugagugcuacaauccaugcuucuacguagaguugauuagaggaagacccgaagaggcuaaauauguaugguggacaaguaacagucuaauugcccuaugugggagcccauucccaguuggguccgguuccuuccccgauggggcacagauccaauacuuuucguaa

SEQ ID NO: 54131 - RNA, 1416 nt, Artificial Sequence
  neuraminidase__InfluenzaA__AGQ81865
augaauccaaaucagaaacuauucgcauuauccggaguggcaauagcacuuaguguacugaacuuauugauaggacucucaaaugucggauugaauguaucucuacaucuaaaggaaacaggacccaaacaggaagggaauuuaacaugcaugaccauuaaucaaaacaacaccacuguaguagaaaacacauacguaaauaauacaacaauaauuaccaaagaaacugaaucggaaacaccaaacuaucugcuguugaacaagagucuauguaauguugaggggugggucgugauagcaaaagacaaugcaguaagauuuggggaaagugagcaaaucauuguuaccagggaaccauacguaucaugugacccaaauggaugcaaaauguaugccuugcaucaagggacuaccauuaggaacaaacauucaaauggaacaauucaugauagaacagcuuucaggggucucaucuccacuccauugggcacuccaccaaccguaaguaauagugauuuuauauguguuggauggucaagcacaaccugccaugauggaaucggcagaaugacuaucuguauacaagggaauaaugacaaugcuacagcaacgguuuauuauaacagaaggcugaccacuaccauuaagaccugggccagaaacauucugaggacucaagagucagaauguguaugccacaacggcacaugugcaguuguaaugaccgacgggucggcuaguagucaagcccauacaaaaguaauguauuuccacaagggauugguaguuaaggaggaagcauuaaagggaucggccagacauauugaggaaugcuccuguuacgggcauaaucaaaagguaaccugugugugcagagauaauuggcagggagcaaacagaccuauuauagaaauugacaugaacacauuggaacacacaaguagauaugugugcacaggaauucucaccgauacuagcagacccggggacaaaccuacuggugauuguuccaacccaauaacuggaaguccuggagcuccgggagugaagggauuuggguuucuaaauggggguaauacauggcuugguaggaccaucagccccagaucaagaaguggauuugaaauguugaaaauaccuaaugcagguacugaucccaauucuagaauagcugagcggcaggaaauugucgacaauagcaacuggucaggcuauuccggaagcuuuauugacuauuggaaugauaacagugagugcuacaauccauguuucuauguagaguuaauuagagggagaccugaagaggcuaaauaugugugguggacaaguaacagucuaauugcccuauguggaagcccauucccaguuggguccgguuccuuccccgauggggcacagauccaauacuuuucguaa

SEQ ID NO: 54132 - RNA, 1416 nt, Artificial Sequence
  neuraminidase__InfluenzaA__AGQ81868
augaauccaaaucagaaacuauuugcauuaucuggaguggcaauagcacuuaguguacugaacuuauugauaggaaucucaaacgucggauugaauguaucucuacaucuaaaggaaaaaggacccaagcaagaagagaauucaacaugcacgaccauuaaucaaaacaacacuacuguuguggaaaauacauacgugaauaauacaacaauaauuaccaaggaaacugaauugaaaacaccaagcuaccugcuguugaacaagagccuaugcaauguugaagggugggucgugauagcgaaagacaaugcagugagauucggagaaagugaacaaaucauuguuaccagagagccauacguaucaugcgauccaacaggaugcaaaauguaugccuugcaccaagggacuaccauuaggaacaaacauucaaauggaacaauucaugacagaacagcuuucagaggucucauuuccacuucauugggcacuccaccaaccauaaguaacagugacuucauguguguuggauggucaagcacaacuugccaugaugggauugguagaaugacuaucuguauacaaggaaauaaugacaacgcuacagcaacgguuuauuauaacagaaggcugaccacuaccauuaagaccugggcuaggaacauucugaggacucaagagucagaaugugugugccacaauggcauaugugcaguuguaaugacugacggaucggcuaguagucaagccuauacaaaaguaauguauuuccacaagggguuaguaguuaaggaagaggcauuaaagggaucagccagacacauugaggaaugcuccuguuacgggcacagucaaaaagugaccugugugugcagagauaacuggcagggagcaaauaggccuauuauagaaauugauaugaacacauuggagcacacaaguagauacgugugcaccggaauucucacagacaccagcagaccuggggacaaaucuaguggugauuguuccaauccaauagcuggaaguccuggcgcuccgggagugaagggauucggguuuuuaaauggggauaacacauggcuugguaggaccaucagccccagaucaagaaguggauucgaaauguugaaaauaccuaaugcagguacugaucccaauuccagaauagcaggacggcaggaaauugucgacaauaacaauuggucaggcuauuccggaagcuuuauugacuauuggaaugauaacagcgagugcuacaauccaugcuucuacguagaguugauuagaggaagacccgaagaggcuaaauauguaugguggacaaguaacagucuaauugcccuaugugggagcccauucccaguuggguccgguuccuuccccgauggggcacagauccaauacuuuucguaa

SEQ ID NO: 54133 - RNA, 1416 nt, Artificial Sequence
  neuraminidase__InfluenzaA__AGQ81869
augaauccaaaucagaaacuguuugcauuaucuggaguggcaauagcacuuaguguacugaacuuauugauaggaaucucaaaugucggauugaauguaucucuacaucuaaaggaaaaaggacccaagcaagaagagaauucgacaugcacgaccauuaaucaaaacaacacuacuauuguggaaaacacauacgugaauaauacaacaauaauuuccaaggaaacugaauuaaaaacaccaagcuaccugcuguuaaacaagagccuaugcaauguugaaggaugggucgugauagcgaaggacaaugcaguaagauucggggaaagugagcaaaucauuguuaccagagagccguacguaucaugcgauccaacaggaugcaaaauguaugccuugcaccaaggaaccaccauuaggaacaaacauucaaauggaacaauucaugacagaacugcuuucagaggucucauuuccacuccauugggcacuccaccaaccguaaguaacagugacuucauauguguuggauggucaagcacaacuugccaugaugggauugguagaaugacuaucugcauacaaggaaauaaugacaacgcuacagcaacaguuuauuauaacagaaggcugacuacuaccauuaggaccugggcuaggaacauucugaggacucaagagucagaaugugugugccacaauggcacaugugcaguuguaaugacugacggaucggcuaguagucaagccuauacaaaaguaauguacuuccacaagggguuaguaauuaaggaagaggcauuaaagggaucagccagacacauugaggaaugcuccuguuacggacacagucaaaaggcgaccugugugugcagggauaacuggcagggagcaaauaggcccauuauagaaauugauaugaacacauuggagcacacaaguagauacguaugcaccggaauccucacagacaccagcagaccuggggacaagucuaguggugauuguuccaauccaauaacuggaaguccuggcgcuccgggagugaagggauucggguuuuuaaauggggauaacacauggcuugguaggaccaucagccccagaucaagaaguggauucgaaauguugaaaauaccuaaugcagguacugaucccaauucuagaauagcagaacggcaggaaauugucgacaauaacaauuggucaggcuauuccggaagcuuuauugacuauuggaauaaugacagugagugcuacaauccaugcuucuacguagaguugauuagaggaagacccgaagaggcuaaguauguaugguggacaaguaacagucuaauugcccuaugugggagcccauucccaguuggguccgguuccuuccccgauggggcacagauccaauacuuuucguaa

SEQ ID NO: 54134 - RNA, 1416 nt, Artificial Sequence
  neuraminidase__InfluenzaA__AGQ81870
augaauccaaaucagaaacuauuugcauuaucuggaguggcaauagcacuuaguguacugaacuuauugauaggaaucucaaaugucggauugaauguaucucuacaucuaaaggaaaaaggacccaagcaagaagagaauucgacaugcacgaccauuaaucaaaacaacacuacuauuguggaaaacacauacgugaauaauacaacaauaauuuccaaggaaacugaauuaaaaccaccaagcuaccugcuguuaaacaagagccuaugcaauguugaaggaugggucgugauagcgaaggacaaugcaguaagauucggggaaagugagcaaaucauuguuaccagagagccguacguaucaugcgauccaacaggaugcaaaauguaugccuugcaccaaggaaccaccauuaggaacaaacauucaaauggaacaauucaugacagaacugcuuucagaggucucauuuccacuccauugggcacuccaccaaccguaaguaacagugacuucauauguguuggauggucaagcacaacuugccaugaugggauugguagaaugacuaucugcauacaaggaaauaaugacaacgcuacagcaacaguuuauuauaacagaaggcugacuacuaccauuaggaccugggcuaggaacauucugaggacucaagagucagaaugugugugccacaauggcacaugugcaguuguaaugacugacggaucggcuaguagucaagccuauacaaaaguaauguacuuccacaagggguuaguaauuaaggaagaggcauuaaagggaucagccagacacauugaggaaugcuccuguuacggacacagucaaaaggcgaccugugugugcagggauaacuggcagggagcaaauaggccuauuauagaaauugauaugaacacauuggagcacacaaguagauacgugugcaccggaauccucacagacaccagcagaccuggggacaagucuaguggugauuguuccaauccaauaacuggaaguccuggcgcuccgggagugaagggauucggguuuuuaaauggggauaacacauggcuugguaggaccaucagccccagaucaagaaguggauucgaaauguugaaaauaccuaaugcagguacugaucccaauucuagaauagcagaacggcaggaaauugucgacaauaacaauuggucaggcuauuccggaagcuuuauugacuauuggaauaaugacagugagugcuacaauccaugcuucuacguagaguugauuagaggaagacccgaagaggcuaaguauguaugguggacaaguaacagucuaauugcccuaugugggagcccauucccaguuggguccgguuccuuccccgauggggcacagauccaauacuuuucguaa

SEQ ID NO: 54135 - RNA, 1416 nt, Artificial Sequence
  neuraminidase__InfluenzaA__AGQ81871
augaauccaaaucagaaacuauuugcauuaucuggaguggcaauagcacuuaguguacugaacuuauugauaggaaucucaaaugucggauugaauguaucucuacaucuaaaggaaaaaggacccaagcaagaagagaauucgacaugcacgaccauuaaucaaaacaacacuacuauuguggaaaacacauacgugaauaauacaacaauaauuuccaaggaaacugaauuaaaaacaccaagcuaccugcuguuaaacaagagccuaugcaauguugaaggaugggucgugauagcgaaggacaaugcaguaagauucggggaaagugagcaaaucauuguuaccagagagccguacguaucaugcgauccaacaggaugcaaaauguaugccuugcaccaaggaaccaccauuaggaacaaacauucaaauggaacaauucaugacagaacugcuuucagaggucucauuuccacuccauugggcacuccaccaaccguaaguaacagugacuucauauguauuggauggucaagcacaacuugccaugaugggauugguagaaugacuaucugcauacaaggaaauaaugacaacgcuacagcaacaguuuauuauaacagaaggcugacuacuaccauuaggaccugggcuaggaacauucugaggacucaagagucagaaugugugugccacaauggcacaugugcaguuguaaugacugacggaucggcuaguagucaagccuauacaaaaguaauguacuuccacaagggguuaguaauuaaggaagaggcauuaaagggaucagccagacacauugaggaaugcuccuguuacggacacagucaaaaggcgaccugugugugcagggauaacuggcagggagcaaauaggcccauuauagaaauugauaugaacacauuggagcacacaaguagauacgugugcaccggaauccucacagacaccagcagaccuggggacaagucuaguggugauuguuccaauccaauaacuggaaguccuggcgcuccgggagugaagggauucggguuuuuaaauggggauaacacauggcuugguaggaccaucagccccagaucaagaaguggauucgaaauguugaaaauaccuaaugcaggcacugaucccaauucuagaauagcagaacggcaggaaauugucgacaauaacaauuggucaggcuauuccggaagcuuuaucgacuauuggaauaaugacagugagugcuacaauccaugcuucuacguagaguugauuagaggaagacccgaagaggcuaaguauguaugguggacaaguaacagucuaauugcccuaugugggagcccauucccaguuggguccgguuccuuccccgauggggcacagauccaauacuuuucguaa

SEQ ID NO: 54136 - RNA, 1416 nt, Artificial Sequence
  neuraminidase__InfluenzaA__AGQ81872
augaauccaaaucagaaacuauuugcauuaucuggaguggcaauagcacuuaguguacugaacuuauugauaggaaucucaaaugucggauugaauguaucucuacaucuaaaggaaaaaggacccaagcaagaagagaauucgacaugcacgaccauuaaucaaaacaacacuacuauuguggaaaacacauacgugaauaauacaacaauaauuuccaaggaaacugaauuaaaaacaccaaguuaccugcuguuaaacaagagccuaugcaauguugaaggaugggucgugauagcgaaggacaaugcaguaagauucggggaaagugagcaaaucauuguuaccagagagccguacguaucaugcgauccaacaggaugcaaaauguaugccuugcaccaaggaaccaccauuaggaacaaacauucaaauggaacaauucaugacagaacugcuuucagaggucucauuuccacuccauugggcacuccaccaagcguaaguaacagugacuucauauguguuggauggucaagcacaacuugccaugaugggauugguagaaugacuaucugcauacaaggaaauaaugacaacgcuacagcaacaguuuauuauaacagaagguugacuacuaccauuaggaccugggcuaggaacauucugaggacucaagagucagaaugugugugccacaauggcacaugugcaguuguaaugacugacggaucggcuaguagucaagccuauacaaaaguaauguauuuccacaagggguuaguaauuaaggaagaggcauuaaagggaucagccagacacauugaggaaugcuccuguuacggacacagucaaaaggcgaccugugugugcagggauaacuggcagggagcaaauaggcccauuauagaaauugauaugaacacauuggagcacacaaguagauacgugugcaccggaauccucacagacaccagcagaccuggggacaagucuaguggugauuguuccaauccaauaacuggaaguccuggcgcuccgggagugaagggauucggguuuuuaaauggggauaacacauggcuugguaggaccaucagccccagaucaagaaguggauucgaaauguugaaaauaccuaaugcagguacugaucccaauucuagaauagcagaacggcaggaaauugucgacaauaacaauuggucaggcuauuccggaagcuuuauugacuauuggaauaaugacagugagugcuacaauccaugcuucuacguagaguugauuagaggaagacccgaagaggcuaaguauguaugguggacaaguaacagucuaauugcccuaugugggagcccauucccaguuggguccgguuccuuccccgauggggcacagauccaauacuuuucguaa

SEQ ID NO: 54137 - RNA, 1416 nt, Artificial Sequence
  neuraminidase__InfluenzaA__AGQ81875
augaauccaaaucagaaacuauuugcauuaucuggaguggcaauagcacuuaguguacugaauuuauugauaggaaucucaaaugucggauugaauguaucucuacaucuaaaggaaaagggacccaaacaggaagagaauucaacaugcaugaccaucaaucaaaacaacacuacaguaguagaaaacacauacguaaauaacacaacaauaauuaccaaggaaacugaauuggaaacaccaagcuaucugcuuuugaacaagggucuaugcaauguugagggaugggucgugauagcaaaagacaaugcaguaagauuuggggaaacugaacaaaucauuguuaccagggaaccauacguaucaugugacccaaauggaugcaaaauguaugccuugcaucaagggacuaccauuaggaacaaacauucaaaugggacaauucaugacagaacagcuuucagaggucucauuuccacuccauugggcacuccaccaaccguaaguaacagugacuuuauauguguuggauggucaagcacaacuugccaugauggaauuggcagaaugacuaucuguauacaaggaaauaaugacaacgcuacagcaacgguuuacuacaacagaaggcugaccacuaccauuaagaccugggccagaaacauucugaggacucaagagucagaaugugugugccacaauggcacaugugcaguuguaaugacugacggaucggcuaguagucaagcccauacaaaaguaauauauuuccacaagggauuaauagucaaggaggaggcauuaaaggguucagcuagacauauugaggaaugcuccuguuacgggcacagucaaaaggugaccugugugugcagagauaauuggcagggggcaaacaggccuauuauagaaauugacaugaacacauuggagcacacaaguagauaugugugcaccggaauucucacugacacuagcagacccggggacaaaucuacuggugauuguuccaauccaauaacuggaagcccuggcgcuccgggagugaagggauuuggguaucuaaauggggauaacacauggcuugguaggaccaucagccccagaucaagaaguggauuugaaauguugaaaauaccuaaugcagguacugaucccaauucuagaauaaccgaacgacaggaaaucgucgacaauaacaauuggucaggcuauuccggaagcuuuguugacuauuggaaugauaacagugagugcuacaauccauguuucuacguagaguuaauuagagggagacccgaagaggcuaaauauguaugguggacaaguaacaguauaauugcccuauguggaagcccauucccaguuggguccgguuccuuccccgauggggcacagauccaauacuuuucguaa

SEQ ID NO: 54138 - RNA, 1416 nt, Artificial Sequence
  neuraminidase__InfluenzaA__AGQ81876
augaauccaaaucagaaacuauuugcauuaucuggaguggcaauagcacuuaguguacugaauuuauugauaggaaucucaaaugucggauugaauguaucucuacaucuaaaggaaaagggacccaaacaggaagagaauucaacaugcaugaccaucaaucaaaacaacacuacaguaguagaaaacacauacguaaauaacacaacaauaauuaccaaggaaacugaauuggaaacaccaagcuaucugcuguugaacaagggucuaugcaauguugagggaugggucgugauagcaaaagacaaugcaguaagauuuggggaaacugaacaaaucauuguuaccagggaaccauacguaucaugugacccaaauggaugcaaaauguaugccuugcaucaagggacuaccauuaggaacaaacauucaaaugggacaauucaugacagaacagcuuucagaggucucauuuccacuccauugggcacuccaccaaccguaaguaacagugacuuuauauguguuggauggucaagcacaacuugccaugauggaauuggcagaaugacuaucuguauacaaggagauaaugacaacgcuacagcaacgguuuacuacaacagaaggcugaccacuaccaucaagaccugggccagaaacauucugaggacucaagagucagaaugugugugccacaauggcacaugcgcaguuguaaugacugacggaucggcuaguagucaagcccauacaaaaguaauauauuuccacaagggacuaauagucaaggaggaggcauuaaaggguucagcuagacauauugaggaaugcuccuguuacgggcacagucaaaaggugaccugugugugcagagauaauuggcagggggcaaacaggccuauuauagaaauugacaugaacacauuggagcacacaaguagauaugugugcaccggaauucucacugacacuagcagacccggggacaaaucuacuggugauuguuccaauccaauaacuggaagcccuggcgcuccgggagugaagggauuuggguaucuaaauggggauaacacauggcuugguaggaccaucagccccagaucaagaaguggauuugaaauguugaaaauaccuaaugcagguacugaucccaauucuagaauaaccgaacgacaggaaaucgucgacaauaacaauuggucaggcuauuccggaagcuuuguugacuauuggaaugauaacagugagugcuacaauccauguuucuacguagaguuaauuagagggagacccgaagaggcuaaauauguaugguggacaaguaacaguauaauugcccuauguggaagcccauucccaguuggguccgguuccuuccccgauggggcacagauccaauacuuuucguaa

SEQ ID NO: 54139 - RNA, 1416 nt, Artificial Sequence
  neuraminidase__InfluenzaA__AGQ81877
augaauccaaaucagaaacuauuugcauuaucuggaguggcaauagcacuuaguguacugaacuuauugauaggaaucucaaacgucggauugaauguaucucuacaucuaaaggaaaaaggacccaagcaagaagagaauucaacaugcacgaccauuaaucaaaacaacacuacuguuguggaaaauacauacgugaauaauacaacaauaauuaccaaggaaacugaauugaaaacaccaagcuaccugcuguugaacaagagccuaugcaauguugaagggugggucgugauagcgaaagacaaugcagugagauucggagaaagugaacaaaucauuguuaccagagagccauacguaucaugcgauccaacaggaugcaaaauguaugccuugcaccaagggacuaccauuaggaacaaacauucaaauggaacaauucaugacagaacagcuuucagaggucucauuuccacuucauugggcacuccaccaaccauaaguaacagugacuucauguguguuggauggucaagcacaacuugccaugaugggauugguagaaugacuaucuguauacaaggaaauaaugacaacgcuacagcaacgguuuauuauaacagaaggcugaccacuaccauuaagaccugggcuaggaacauucugaggacucaagagucagaaugugugugccacaauggcauaugugcaguuguaaugacugacggaucggcuaguagucaagccuauacaaaaguaauguauuuccacaagggguuaguaguuaaggaagaggcauuaaagggaucagccagacacauugaggaaugcuccuguuacgggcacagucaaaaagugaccugugugugcagagauaacuggcagggagcaaauaggccuauuauagaaauugauaugaacacauuggagcacacaaguagauacgugugcaccggaauucucacagacaccagcagaccuggggacaaaucuaguggugauuguuccaauccaauaacuggaaguccuggcgcuccgggagugaagggauucggguuuuuaaauggggauaacacauggcuugguaggaccaucagccccagaucaagaaguggauucgaaauguugaaaauaccuaaugcagguacugaucccaauuccagaauagcaggacggcaggaaauugucgacaauaacaauuggucaggcuauuccggaagcuuuauugacuauuggaaugauaacagcgagugcuacaauccaugcuucuacguagaguugauuagaggaagacccgaagaggcuaaauauguaugguggacaaguaacagucuaauugcccuaugugggagcccauucccaguuggguccgguuccuuccccgauggggcacagauccaauacuuuucguaa

SEQ ID NO: 54140 - RNA, 1416 nt, Artificial Sequence
  neuraminidase__InfluenzaA__AGQ81878
augaauccaaaucagaaacuauuugcauuaucuggaguggcgauagcacuuaguguacugaacuuauugauaggaaucucaaaugucggauugaauguaucucuacaucuaaaggaaaaaggacccaaacaggaagagaauuuaacaugcacgaccauuaaucaaaacaacacuacuguaguagaaaacacauacguaaauaacacaacaauaauuaccaaggaaacugauuugaaagcaccaagcuauuugcuguugaacaagagccuaugcaauguugaagggugggucgugauagcaaaagacaaugcaguaagauuuggggaaagugaacaaaucauuguuaccagggagccauacguaucaugcgacccaacaggaugcaaaauguaugccuuacaccaagggacuaccauuaggaacaaacauucaaauggaacgauucaugacagaacagcuuucagaggucucauuuccacuccacuaggcacuccaccaaccguaaguaacagugacuuuauguguguuggauggucaagcacaacuugccaugaugggauuggcagaaugacuaucuguauacaagggaauaaugacaacgcuacagcaacgguuuauuauaauagaaggcugaccacuaccauuaagaccugggccagaaacauucugaggacucaagagucagaaugugugugccauaauggcacaugugcaguuguaaugaccgacggaucagcuaguagucaagccuauacaaaaguaauguauuuccacaaggggcuagugguuaaggaggaggcauuaaagggaucagccagacauauugaggaaugcuccuguuacggacacagucaaaaggugaccugugugugcagagauaacuggcagggagcaaacaggccuauuauagaaauugacaugaacacauuggagcacacaaguagauacgugugcacuggaauucucacagacaccagcagaccuggagacaaaucuaguggugauuguuccaauccaauaacugggagucccggcgcuccgggagugaaggguuucggguuucuaaauggggauaacacauggcuugguaggaccaucagccccagaucaagaaguggauucgaaauguugaaaauaccuaaugcagguacugaucccaauucuagaauagcagaacgacaggaaauugucgacaauaacaauuggucaggcuauuccgggagcuuuauugacuauuggaaugauaacagugagugcuacaauccaugcuuuuacguggaguuaauuagaggaagacccgaagaggcuaaauacguaugguggacaaguaacagucuaauugcccuauguggaagcccauucccaauuggguccgguuccuuccccgauggggcgcagauccaauacuuuucguaa

SEQ ID NO: 54141 - RNA, 1416 nt, Artificial Sequence
  neuraminidase__InfluenzaA__AGQ81882
augaauccaaaucagaaacuauuugcacuaucuggaguggcaauagcgcuuaguguacugaacuuauuaauaggaaucucaaaugucggauugaacguuucccuacaucugaaggaaaaaggggccaaacaagaggagaauuuaacaugcacgaccauuaaucaaaacaacacuacuguaguagaaaacacauauguaaauaauacaacaguaauuaccaaggaagcugauuggaaaacaccaagcuaucugcuguugaacaagagccuaugcaauguugaaggcuggguugugauagcaaaagacaacgcaauaagauuuggggaaagugaacaaaucauuguuaccagggagccguauguaucaugcgacccaacaggaugcaagauguaugcccugcaccaagggaccaccauuagaaacaaacauucaaauggaacgauucaugacagaacagcuuucagaggucucaucuccacuccauugggcacuccaccaaccguaaguaacagugacuucauguguguuggguggucaagcacgacuugccaugauggaauuggcagaaugacuauuuguauacaaggaaauaaugacaacgccacagcaacaguuuauuauaauggaaggcugaccaccacaauuaagacaugggcaagaaacauccugaggacucaagagucagaaugugugugccacaauggcacaugugcaguugugaugaccgacggaucggcuagcagucaagccuauacaaaagugauguauuuccacaagggguuagugauuaaggaggaggcauuaaagggaucggccagacacauugaggaaugcuccuguuacggacacagucaaaaggugaccuguguguguagagauaacuggcagggagcaaacaggccuauuauagaaauugacaugaacacauuggaacacacaaguagauacguaugcacuggaauccucacagacaccagcagaccuggugacaaaucuaguggugacuguuccaauccgauaacugggagucccggcgcuccgggggugaagggauucggguuucuaaauggggauaacacauggcuugguaggaccaucagucccaggucaagaaguggauucgaaauguugaaaauacccaaugcagguauugaucccaauucuagaauagcagaacgacaagaaauugucgacaauaacaauuggucaggcuauucaggaagcuucauugacuauuggaaugacaacagugagugcuacaauccaugcuuuuacguagaguuaauuagaggaagacccgaagaggccaaguacguaugguggacaaguaauagucuaauugcccuauguggaagcccauucccaguuggguccgguuccuuccccgauggggcacagauccaauacuuuucguaa

SEQ ID NO: 54142 - RNA, 1416 nt, Artificial Sequence
  neuraminidase__InfluenzaA__AGQ81883
augaauccaaaucagaaacuauuugcacuaucuggaguggcaauagcgcuuaguguacugaacuuauuaauaggaaucucaaaugucggauugaacguuucccuacaucugaaggaaaaagggcccaaacaagaggagaauuuaacaugcacgaccauuaaucaaaacaacacuacuguaguagaaaacacauauguaaauaauacaacaguaauuaccaaggaagcugauuggaaaacaccaagcuaucugcuguugaacaagagccuaugcaauguugaaggcuggguugugauagcaaaagacaacgcaauaagauuuggggaaagugaacaaaucauuguuaccagggagccguauguaucaugcgacccaacaggaugcaagauguaugcccugcaccaagggaccaccauuagaaacaaacauucaaauggaacgauucaugacagaacagcuuucagaggucucaucuccacuccauugggcacuccaccaaccguaaguaacagugacuucauguguguuggguggucaagcacgacuugccaugauggaauuggcagaaugacuauuuguauacaaggaaauaaugacaacgccacagcaacaguuuauuauaauggaaggcugaccaccacaauuaagacaugggcaagaaacauccugaggacucaagagucagaaugugugugccacaauggcacaugugcaguugugaugaccgacggaucggcuagcagucaagccuauacaaaagugauguauuuccacaagggguuagugauuaaggaggaggcauuaaagggaucggccagacacauugaggaaugcuccuguuacggacacagucaaaaggugaccuguguguguagagauaacuggcagggagcaaacaggccuauuauagaaauugacaugaacacauuggaacacacaaguagauacguaugcacuggaauccucacagacaccagcagaccuggugacaaaucuaguggugacuguuccaauccgauaacugggagucccggcgcuccgggggugaagggauucggguuucuaaauggggauaacacauggcuugguaggaccaucagucccaggucaagaaguggauucgaaauguugaaaauacccaaugcagguauugaucccaauucuagaauagcagaacgacaagaaauugucgacaauaacaauuggucaggcuauucaggaagcuucauugacuauuggaaugacaacagugagugcuacaauccaugcuuuuacguagaguuaauuagaggaagacccgaagaggccaaguacguaugguggacaaguaauagucuaauugcccuauguggaagcccauucccaguuggguccgguuccuuccccgauggggcacagauccaauacuuuucguaa

SEQ ID NO: 54143 - RNA, 1416 nt, Artificial Sequence
  neuraminidase__InfluenzaA__AGQ81884
augaauccaaaucagaaacuauuugcacuaucuggaguggcaauagcgcuuaguguacugaacuuauuaauaggaaucucaaaugucggauugaacguuucccuacaucugaaggaaaaagggcccaaacaagaggagaauuuaacaugcacgaccauuaaucaaaacaacacuacuguaguagaaaacacauauguaaauaauacaacaguaauuaccaaggaagcugauuggaaaacaccaagcuaucugcuguugaacaagagccuaugcaauguugaaggcuggguugugauagcaaaagacaacgcaauaagauuuggggaaagugaacaaaucauuguuaccagggagccguauguaucaugcgacccaacaggaugcaagauguaugcccugcaccaagggaccaccauuagaaacaaacauucaaauggaacgauucaugacagaacagcuuucagaggucucaucuccacuccauugggcacuccaccaaccguaaguaacagugacuucauguguguuggguggucaagcacgacuugccaugauggaauuggcagaaugacuauuuguauacaaggaaauaaugacaacgccacagcaacaguuuauuauaauggaaggcugaccaccacaauuaagacaugggcaagaaacauccugaggacucaagagucagaaugugugugccacaauggcacaugugcaguugugaugaccgacggaucggcuagcagucaagccuauacaaaagugauguauuuccacaagggguuagugauuaaggaggaggcauuaaagggaucggccagacacauugaggaaugcuccuguuacggacacagucaaaaggugaccuguguguguagagauaacuggcagggagcaaacaggccuauuauagaaauugacaugaacacauuggaacacacaaguagauacguaugcacuggaauccucacagacaccagcagaccuggugacaaaucuaguggugacuguuccaauccgauaacugggagucccggcgcuccgggggugaagggauucggguuucuaaauggggauaacacauggcuugguaggaccaucagucccaggucaagaaguggauucgaaauguugaaaauacccaaugcagguauugaucccaauucuagaauagcagaacgacaagaaauugucgacaauaacaauuggucaggcuauucagggagcuucauugacuauuggaaugacaacagugagugcuacaauccaugcuuuuacguagaguuaauuagaggaagacccgaagaggccaaguacguaugguggacaaguaauagucuaauugcccuauguggaagcccauucccaguuggguccgguuccuuccccgauggggcacagauccaauacuuuucguaa

SEQ ID NO: 54144 - RNA, 1416 nt, Artificial Sequence
  neuraminidase__InfluenzaA__AGQ81885
augaauccaaaucagaaacuauuugcacuaucuggaguggcaauagcgcuuaguguacugaacuuauuaauaggaaucucaaaugucggauugaacguuucccuacaucugaaggaaaaagggcccaaacaagaggagaauuuaacaugcacgaccauuaaucaaaacaacacuacuguaguagaaaacacauauguaaauaauacaacaguaauuaccaaggaagcugauuggaaaacaccaagcuaucugcuguugaacaagagccuaugcaauguugaaggcuggguugugauagcaaaagacaacgcaauaagauuuggggaaagugaacaaaucauuguuaccagggagccguauguaucaugcgacccaacaggaugcaagauguaugcccugcaccaagggaccaccauuagaaacaaacauucaaauggaacgauucaugacagaacagcuuucagaggucucaucuccacuccauugggcacuccaccaaccguaaguaacagugacuucauguguguuggguggucaagcacgacuugccaugauggaauuggcagaaugacuauuuguauacagggaaauaaugacaacgccacagcaacaguuuauuauaauggaaggcugaccaccacaauuaagacaugggcaagaaacauccugaggacucaagagucagaaugugugugccacaauggcacaugugcaguugugaugaccgauggaucggcuagcagucaagccuauacaaaaguaauguauuuccacaagggguuagugauuaaggaggaggcauuaaagggaucggccagacacauugaggaaugcuccuguuacggacacagucaaaaggugaccuguguguguagagauaacuggcagggagcaaacaggccuauuauagaaauugacaugaacacauuggaacacacaaguagauacguaugcacuggaauccucacagacaccagcagaccuggugacaaaucuaguggugacuguuccaauccgauaacugggagucccggcgcuccgggggugaagggauucggguuucuaaauggggauaacacauggcuugguaggaccaucagucccaggucaagaaguggauucgaaauguugaaaauacccaaugcagguauugaucccaauucuagaauagcagaacgacaagaaauugucgacaauaacaauuggucaggcuauucaggaagcuucauugacuauuggaaugacaacagugagugcuacaauccaugcuuuuacguagaguuaauuagaggaagacccgaagaggccaaguacguaugguggacaaguaauagucuaauugcccuauguggaagcccauucccaguuggguccgguuccuuccccgauggggcacagauccaauacuuuucguaa

SEQ ID NO: 54145 - RNA, 1416 nt, Artificial Sequence
  neuraminidase__InfluenzaA__AGQ81886
augaauccaaaucagaaacuauuugcacuaucuggaguggcaauagcgcuuaguguacugaacuuauuaauaggaaucucaaaugucggauugaacguuucccuacaucugaaggaaaaagggcccaaacaagaggagaauuuaacaugcacgaccauuaaucaaaacaacacuacuguaguagaaaacacauauguaaauaauacaacaguaauuaccaaggaagcugauuggaaaacaccaagcuaucugcuguugaacaagagccuaugcaauguugaaggcuggguugugauagcaaaagacaacgcaauaagauuuggggaaagugaacaaaucauuguuaccagggagccguauguaucaugcgacccaacaggaugcaagauguaugcccugcaccaagggaccaccauuagaaacaaacauucaaauggaacgauucaugacagaacagcuuucagaggucucaucuccacuccauugggcacuccaccaaccguaaguaacagugacuucauguguguuggguggucaagcacgacuugccaugauggaauuggcagaaugacuauuuguauacaaggaaauaaugacaacgccacagcaacaguuuauuauaauggaaggcugaccaccacaauuaagacaugggcaagaaacauccugaggacucaagagucagaaugugugugccacaauggcacaugugcaguugugaugaccgacggaucggcuagcagucaagccuauacaaaaguaauguauuuccacaagggguuagugauuaaggaggaggcauuaaagggaucggccagacacauugaggaaugcuccuguuacgggcacagucaaaaggugaccuguguguguagagauaacuggcagggagcaaacaggccuauuauagaaauugacaugaacacauuggaacacacaaguagauacguaugcacuggaauccucacagacaccagcagaccuggugacaaaucuaguggugacuguuccaauccgauaacugggagucccggcgcuccgggggugaagggauucggguuucuaaauggggauaacacauggcuugguaggaccaucagucccaggucaagaaguggauucgaaauguugaaaauacccaaugcagguauugaucccaauucuagaauagcagaacgacaagaaauugucgacaauaacaauuggucaggcuauucaggaagcuucauugacuauuggaaugacaacagugagugcuacaauccaugcuuuuacguagaguuaauuagaggaagacccgaagaggccaaauacguaugguggacaaguaauagucuaauugcccuauguggaagcccauucccaguuggguccgguuccuuccccgauggggcacagauccaauacuuuucguaa

SEQ ID NO: 54146 - RNA, 1356 nt, Artificial Sequence
  neuraminidase__InfluenzaA__AGQ81888
augaauccaaaucagaaacuauucgcauuauccggaguggcaauagcgcuuaguguacugaacuuauugauaggacucucaaaugucggauugaauguaucucuacaucuaaaagaagcaggacccaaacaggaagagaauuugacaugcaugacuaccaaagaaacugaauugggaacaccaagcuaucugcuguugaacaagagucuauguaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuuuagaggccucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54147 - RNA, 1356 nt, Artificial Sequence
  neuraminidase__InfluenzaA__AGQ81889
augaauccaaaucagaaacuauucgcauuauccggaguggcaauagcgcuuaguguacugaaccuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugacagaugggucggcuaguagucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54148 - RNA, 1356 nt, Artificial Sequence
  neuraminidase__InfluenzaA__AGQ81890
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuaugcaauguugaggggugggucgugauagcaaaagacaaugcaguaagauuuggggaaagugagcaaaucauuauuaccagagaaccauacguaucaugugacccaaauggaugcaaaauguaugccuugcaucaagggaccaccauuaggaacaaacauucaaacggaacaauucacgacagaacagccuucaggggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucugccaaacauauugaggaaugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54149 - RNA, 1356 nt, Artificial Sequence
  neuraminidase__InfluenzaA__AGQ81891
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuaugcaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucaggggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucugccaaacauauugaggaaugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54150 - RNA, 1356 nt, Artificial Sequence
  neuraminidase__InfluenzaA__AGQ81893
augaauccaaaucagaaacuauucgcauuauccggaguggcaauagcgcuuaguguacugaaccuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauucaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugacagaugggucggcuaguagucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcugaauaugugugguggacaaguaacagucuaauugcccuauguggaagcccauucccaguuggguccgguuccuuccccgauggggcacagauccaauacuuuucguaa

SEQ ID NO: 54151 - RNA, 1356 nt, Artificial Sequence
  neuraminidase__InfluenzaA__AGQ81894
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaagaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54152 - RNA, 1356 nt, Artificial Sequence
  neuraminidase__InfluenzaA__AGQ81895
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaggggugggucgugauagcaaaagacaaugcaguaagauuuggggaaagugagcaaaucauuaucaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54153 - RNA, 1356 nt, Artificial Sequence; identical to SEQ ID NO: 54147
  neuraminidase__InfluenzaA__AGQ81896

SEQ ID NO: 54154 - RNA, 1356 nt, Artificial Sequence; identical to SEQ ID NO: 54147
  neuraminidase__InfluenzaA__AGQ81897

SEQ ID NO: 54155 - RNA, 1356 nt, Artificial Sequence; identical to SEQ ID NO: 54147
  neuraminidase__InfluenzaA__AGQ81898

SEQ ID NO: 54156 - RNA, 1356 nt, Artificial Sequence; identical to SEQ ID NO: 54147
  neuraminidase__InfluenzaA__AGQ81899

SEQ ID NO: 54157 - RNA, 1356 nt, Artificial Sequence
  neuraminidase__InfluenzaA__AGQ81900
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuaugcaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucaggggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucggccaaacauauugaggaaugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54158 - RNA, 1356 nt, Artificial Sequence; identical to SEQ ID NO: 54149
  neuraminidase__InfluenzaA__AGQ81901

SEQ ID NO: 54159 - RNA, 1356 nt, Artificial Sequence
  neuraminidase__InfluenzaA__AGQ81902
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugccacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagaccugaagaggcuaaauaugugugguggacaaguaacagucuaauugcccuauguggaagcccauucccaguuggguccgguuccuuccccgauggggcacagauccaauacuuuucguaa

SEQ ID NO: 54160 - RNA, 1356 nt, Artificial Sequence; identical to SEQ ID NO: 54157
  neuraminidase__InfluenzaA__AGQ81903

SEQ ID NO: 54161 - RNA, 1356 nt, Artificial Sequence
  neuraminidase__InfluenzaA__AGQ81904
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugccacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauaacugagcggcaggaaauugucgacaacagcaauuggucaggcuauuccggaagcuuuauugacuauuggaaugauaacagugaguguuacaauccauguuucuacguagaguuaauuagagggagaccugaagaggcuaaauaugugugguggacaaguaacagucuaauugcccuauguggaagcccauucccaguuggguccgguuccuuccccgauggggcacagauccaauacuuuucguaa

SEQ ID NO: 54162 - RNA, 1356 nt, Artificial Sequence
  neuraminidase__InfluenzaA__AGQ81905
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54163 - RNA, 1356 nt, Artificial Sequence
  neuraminidase__InfluenzaA__AGQ81906
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugccacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucggccagacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagaccugaagaggcuaaauaugugugguggacaaguaacagucuaauugcccuauguggaagcccauucccaguuggguccgguuccuuccccgauggggcacagauccaauacuuuucguaa

SEQ ID NO: 54164 - RNA, 1356 nt, Artificial Sequence; identical to SEQ ID NO: 54159
  neuraminidase__InfluenzaA__AGQ81907

SEQ ID NO: 54165 - RNA, 1356 nt, Artificial Sequence
  neuraminidase__InfluenzaA__AGQ81908
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaggggugggucgugauagcaaaagacaaugcaguaagauuuggggaaagugagcaaaucauuauuaccagagaaccauacguaucaugugacccaaauggaugcaaaauguaugcccugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugccacagcaacgguuuauuauaacagaaggcugaccacuaccauuaagaccugggcuagaaacauucugaggacucaagagucagaaugugugugccacaacggcacaugugcaguuguaaugaccgaugggucggcuaguaaucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauaacugagcggcaggaaauugucgacaacagcaauuggucaggcuauuccggaagcuuuauugacuauuggaaugauaacagugaguguuacaauccauguuucuacguagaguuaauuagagggagaccugaagaggcuaaauaugugugguggacaaguaacagucuaauugcccuauguggaagcccauucccaguuggguccgguuccuuccccgauggggcacagauccaauacuuuucguaa

SEQ ID NO: 54166 - RNA, 1356 nt, Artificial Sequence; identical to SEQ ID NO: 54149
  neuraminidase__InfluenzaA__AGQ81909

SEQ ID NO: 54167 - RNA, 1356 nt, Artificial Sequence
  neuraminidase__InfluenzaA__AGQ81910
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuaugcaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucaggggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguggucaagcccauacaaaaguaauguauuuccacaagggguugguaguuaaggaggaggcauugaagggaucggccaaacauauugaggaaugcuccuguuacgggcacaaucaaaaggugaccugugugugcagagauaauuggcagggagcaaacagaccuauuauagaaauugacaugaacacauuggaacacacaaguaguuaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54168 - RNA, 1356 nt, Artificial Sequence
  neuraminidase__InfluenzaA__AGQ81911
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuaugcaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucaggggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcuaaccacuaccauuaagaccugggcuagaaacauucugaggacucaagagucagaaugugugugccacaacggcacaugugcaguuguaaugaccgaugggucggcuaguggucaagcccauacaaaaguaauguauuuccacaagggguugguaguuaaggaggaggcauugaagggaucggccaaacauauugaggaaugcuccuguuacgggcacaaucaaaaugugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54169 - RNA, 1356 nt, Artificial Sequence; identical to SEQ ID NO: 54159
  neuraminidase__InfluenzaA__AGQ81912

SEQ ID NO: 54170 - RNA, 1356 nt, Artificial Sequence
  neuraminidase__InfluenzaA__AGQ81913
augaauccaaaucagaaacuauucgcauuauccggaguggcaauaacgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuaugcaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucaggggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguggucaagcccauacaaaaguaauguauuuccacaagggguugguaguuaaggaggaggcauugaagggaucggccaaacauauugaggaaugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54171 - RNA, 1356 nt, Artificial Sequence; identical to SEQ ID NO: 54147
  neuraminidase__InfluenzaA__AGQ81914

SEQ ID NO: 54172 - RNA, 1356 nt, Artificial Sequence; identical to SEQ ID NO: 54151
  neuraminidase__InfluenzaA__AGQ81915

SEQ ID NO: 54173 - RNA, 1416 nt, Artificial Sequence
  neuraminidase__InfluenzaA__AGQ81917
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuuaacaugcaugaccauuaaucaaaacaacaccacuguaguagaaaacacauacguaaauaauacaacaauaauuaccaaagaaacugaauuggaaacaccaaacuaucugcuguugaacaaaagucuauguaauguugagggguggguagugguagcaaaagacaaugcaguaagauuuggggaaagugagcaaaucauuguuaccagagaaccauacguaucaugugacccaaauggaugcaaaauguaugccuugcaccaagggacuaccauuaggaacaaacauucaaauggaacaauucaugacagaacagcuuucaggggucucaucuccacuccauugggcacuccaccaaccguaaguaauagugauuuuauauguguuggauggucaagcacaacuugccaugauggaauuggcagaaugacuaucuguauacaggggaauaaugacaaugcuacagcaacgguuuauuauaacagaaggcugaccacuaccauuaaaaccugggccagaaacauucugaggacucaagagucagaaugugugugccacaacggcacaugugcaguuguaaugaccgaugggucggcuaguagucaagcccauacaaaaguaauguauuuccacaagggauugguaauuaaagaggaggcauuaaagggaucagccaaacauauugaggaaugcuccuguuacgggcacaaucaaaaggugaccugugugugcagagauaauuggcagggagcaaacagaccuaucauagaaauugacaugaacacauuggaacacacaaguagauaugugugcaccggaauucucaccgauacuagcaggcccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaauguugaaaauaccuaaugcagguauugaucccaauucuagaauagcugagcggcaagaaauugucgacaacagcaauuggucaggcuauuccggaagcuuuauugacuauuggaaugauaacagugaguguuacaauccauguuucuacguagaguuaauuagaggaagacccgaggaggcuaaauaugugugguggacaaguaacagucuaauugcccuauguggaagcccauucccaguuggguccgguuccuuccccgauggggcacagauccaauacuuuucguaa

SEQ ID NO: 54174 - RNA, 1356 nt, Artificial Sequence
  neuraminidase__InfluenzaA__AGQ81918
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagggucuauguaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugccacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagaccugaagaggcuaaauaugugugguggacaaguaacagucuaauugcccuauguggaagcccauucccaguuggguccgguuccuuccccgauggggcacagauccaauacuuuucguaa

SEQ ID NO: 54175 - RNA, 1356 nt, Artificial Sequence
  neuraminidase__InfluenzaA__AGQ81919
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaagggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54176 - RNA, 1356 nt, Artificial Sequence; identical to SEQ ID NO: 54157
  neuraminidase__InfluenzaA__AGQ81920

SEQ ID NO: 54177 - RNA, 1356 nt, Artificial Sequence
  neuraminidase__InfluenzaA__AGQ81921
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuaugcaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucaggggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguggucaagcccauacaaaaguaauguauuuccacaagggguugguaguuaaggaggaggcauugaagggaucggccaaacauauugaggaaugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54178 - RNA, 1356 nt, Artificial Sequence; identical to SEQ ID NO: 54159
  neuraminidase__InfluenzaA__AGQ81922

SEQ ID NO: 54179 - RNA, 1356 nt, Artificial Sequence; identical to SEQ ID NO: 54177
  neuraminidase__InfluenzaA__AGQ81923

SEQ ID NO: 54180 - RNA, 1356 nt, Artificial Sequence
  neuraminidase__InfluenzaA__AGQ81924
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuaugcaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucaggggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaauagucaagcccauacaaaaguaauguauuuccacaagggguugguaguuaaggaggaggcauugaagggaucggccaaacauauugaggaaugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54181 - RNA, 1356 nt, Artificial Sequence; identical to SEQ ID NO: 54159
  neuraminidase__InfluenzaA__AGQ81925

SEQ ID NO: 54182 - RNA, 1356 nt, Artificial Sequence; identical to SEQ ID NO: 54159
  neuraminidase__InfluenzaA__AGQ81926

SEQ ID NO: 54183 - RNA, 1356 nt, Artificial Sequence; identical to SEQ ID NO: 54159
  neuraminidase__InfluenzaA__AGQ81927

SEQ ID NO: 54184 - RNA, 1356 nt, Artificial Sequence; identical to SEQ ID NO: 54159
  neuraminidase__InfluenzaA__AGQ81928

SEQ ID NO: 54185 - RNA, 1356 nt, Artificial Sequence; identical to SEQ ID NO: 54157
  neuraminidase__InfluenzaA__AGQ81929

SEQ ID NO: 54186 - RNA, 1413 nt, Artificial Sequence
  neuraminidase__InfluenzaA__AGQ81930
augaauccaaaucaaaaaauaauaaccauuggcuccauaucauuaggauugguuguauucaauguucugcugcaugucguaagcaucauagugacaguauuaguccuugggagagguggaaacagcgggaucuguaacgagacaguagugagggaauacaaugagacagucaggauagagaagauaacucaauggcacaauacuaguguggucgaauacgugccauauuggagugaaggcaauuacaugaauaauacagaggcaauaugugaugucaagggcuuugcaccuuucuccaaagacaaugggauaagaauugguuccagaggacauguuuuugucauaagggagcccuucgucucuuguucgcccacggaaugcagaacuuucuuccucacucagggguccuugcucaaugacaaacacucaaauggaacagugaaagauagaagcccauucaggacucucaugagcgucgaagugggccaaucacccaauguuuaucaagccagauuugaagcuguggcguggucagcaacugccugccaugaugggaagaaguggaugacaauugguguaacagggccggauuccaaggcaguagcaguaguucauuauggaggggugccuacugaugucgucaauuccugggcaggggauauauuaaggacccaagaaucauccugcacuugcauucaagguaauugcuauugggugaugacugacggucccgccaauaggcaggcacaguauaggauauacaaagcaaaucaggguaaaauaguuggccaaacggauaucagcuuuaauggaggacauauugaagaguguucuugcuacccuaaugaugggaaaguggaaugcguauguagagacaauuggacaggaaccaacaggccuguacugguuaucucaccggaucucucuuacagaguuggguauuuaugugcagggcugcccagcgauacuccaagaggggaagaugcccaauuuacugggucaugcacuagccccauggggaaucagggguaugguguaaaaggcuucggauuucggcagggaaccgauguauggauggggcgaacgauuagucgaaccuccagaucaggauuugagauacuaagaauaaagaacgguuggacacagacgaguaaagagcagguuaggaagcaaguaguuguugacaauuugaacuggucgggguacagugggucuuucacccugccaguagaauugucuggaaaagauugcuuggucccuuguuuuuggguugaaaugaucaggggcaagccagaagagaaaacaaucuggacuuccagcagcuccauugugauguguggaguugauuaugaaguugccgauuggucauggcacgauggagcuauucuucccuuugacaucgauaagauguaa

SEQ ID NO: 54187 - RNA, 1413 nt, Artificial Sequence
  neuraminidase__InfluenzaA__AGQ81931
augaauccaaaucagaaaauaauaaccauugggucacuauccuuagggcuaguaguccuuaacauccuccuacauauaauuaguauuacaauaacaguguuaguuauaccuagaaauggaaacacugggaguugcaaugaaacagucauuagggaauacaacgaaacaguaagaauugagaaaauaacacaguggcacaauaccaacaucauugaguauauagagaaaccagagaaugaucuuuucaugaacaacacgggaccguugugugaugcuaaggguuuugcacccuucuccaaagacaacggaauaaggauugggucaaaaggucauguuuuuguuauaagggagccauuuguuucuugcucgccaacagagugcaggacguucuuccuuacucaagguucccuacucaaugacaaacacuccaauggcacagugaaagaccgaagccccuauagaacccuaaugagcguagaaauaggacaaucacccaauguguaccaggcaagguuugaggcaguagcguggucagcuacugcaugucaugaugggaagaaauggaugacaauuggaguaacuggcccugaugccaaagcaguagcaguggugcauuaugggggaauucccacugauguaauuaacucuugggccggagauauucuaaggacccaggaaucaucaugcacuugcauucaaggugaguguuauugggugaugacagaugggccagcaaacagacaagcacaauacagagcauucaaggccaagcagggaaagauaauugggcaaacugagaucaguuucaaugggggucauauagaagaaugcucaugcuacccaaaugaggguaaaguggaguguguuugcagggacaacuggacuggaaccaacaggccaguauuggugauuucuucagaucugucuuacagaguaggauacuuaugugcaggccucccuagugacacuccaagaggagaagauagccaguucacgggaucaugcacuagucccaugggaaaccagggguauggaguuaagggguucggauucagacaaggcaaugauguauggauggggaggaccauuagcaggacaucaaggucaggguuugaaauccugaaaaucagaaauggcuggauacaaaauaguaaagaacagaucaaaaggcaaguuguggucgauaacucaaauuggucaggauacagugguuccuuuacacuaccaguagaguuaacaagaagaaauugucugguuccauguuuuuggguugagaugauaaggggcaagccagaagaaaagacaauauggaccucaaguagcuccauugugauguguggaguagaccaugagauugccaacuggucguggcacgauggagcuauucuuccuuuugacaucgauaagauguaa

SEQ ID NO: 54188 - RNA, 1413 nt, Artificial Sequence
  neuraminidase__InfluenzaA__AGQ81932
augaauccaaaucaaaaaauaauaaccauuggcuccauaucauuaggauugguuguauucaauguccugcugcaugucgugagcaucauagugacaguauuaauccuuggaagagguggaaacaacgggaucuguaacgagacaguagugagggaauacaaugagacagucaggauagagaagauaacucaauggcacaauacuaguguggucgaauacgugccguauuggaaugaaggcacuuacaugaauaauacagaagcaauaugugaugucaaaggcuuugcaccuuucuccaaagacaaugggauaagaauugguuccaggggacauguuuuuguuauaagggagcccuucgucucuuguucgcccacggaaugcagaacuuucuuccucacucaggggucuuugcucaaugacaaacacucaaauggaacagugaaagauagaagcccauucaggacucucaugagugucgaagugggccaaucacccaauguuuaucaagccagauuugaagcuguggcguggucagcaacugccugccaugaugggaagaaguggaugacaauugguguaacagggucagauuccaaggcaguagcaguaguucauuauggaggggugccuacugaugucgucaauuccugggcaggggauauauuaaggacccaagaaucauccugcacuugcauucaagguaauugcuauugggugaugacugacggucccgccaauaggcaggcacaguauaggauauacaaagcaaaucaggguaaaguaauuggccaaacggauaucagcuuuaauggaggacauauugaagaauguucuugcuacccuaaugaugggaaaguggaaugcguauguagagacaauuggacagggaccaacaggccuguacugguuaucucaccggaucucucuuacagaguuggguauuuaugugcagggcugccuagugauacuccaagaggggaagaugcccaauuuacugggucaugcacuagccccauggggaaucagggguaugguguaaaaggcuucggauuucggcagggaacugauguauggauggggcggacaauuagucaaaccuccaggucaggauuugagauacuaagaguaaaaaacgguuggacacagacgaguaaagagcagguuaggaaacagguaguuguugauaauuugaacuggucgggguacagugggucuuucacccugccaauagaauugucuggaaaagauugcuugguaccuuguuuuuggguugaaaugaucaggggcaagccggaagagaaaucaauuuggacuuccagcagcuccauugugauguguggaguugauuaugaaguugccgauuggucauggcacgauggagcuauucuucccuuugacaucgauaagauguaa

SEQ ID NO: 54189 - RNA, 1413 nt, Artificial Sequence
  neuraminidase__InfluenzaA__AGQ81934
augaauccaaaucagaagauucuaugcacuucagccacugcuaucguaauaggcacaaucgcaguacucauaggaauagcaaaccuaggguuaaacauaggacugcaucuaaaaccgagcugcaauugcucacacucacaaccugaaacaaccaacacaagccaaacaauaauaaacaacuauuauaaugaaacaaauaucacccaaauaaguaacaccaacauucaaauggaagaaagagcaagcagagauuucaauaacuugacuaaagggcucuguacuauaaauucauggcacauauaugggaaagacaaugcaguaagaauuggagagaacucagauguuuuagucacaagagaacccuauguuucaugcgacccagaugaaugcagguucuaugcucucagccaaggaacaacaaucagagggaaacacucaaacggaacgauacacgauaggucccaauaccgcgcccugauaagcuggccacuaucaucaccgcccacaguauacaauagcaggguggaaugcauuggguggucaaguacuaguugccaugauggcaaguccaggaugucaauauguauaucaggaccaaacaacaaugcaucugcaguaguaugguacaacagaaggccuguugcagaaauuaacacaugggcccgaaauauacuaagaacacaggaaucugaauguguaugccacaacgguguaugcccaguaguguucacagaugggucugccacuggaccugcagacacaagaauauacuauuucaaagagggaagaauauugaaaugggaaucucugacuggaacugcuaagcauauugaagaaugcucauguuacggggaacgaacaggaauuaccugcacaugcagagacaauuggcagggaucaaauagaccaguaauccgaauagauccaguggcaaugacacauacuagucaguauauaugcagcccuguucucacagacaauccccggccgaaugacccaaauguagguaaguguaacgacccuuauccagguaauaauaacaauggagucaaaggguucucauaccuagauggagucaacacuuggcuagggagaacaauaagcacagcuucgaggucuggguaugagaugcuaaaagugccaaaugcauugacagaugauagaucaaagcccauucaaggucagaccauuguauuaaacacugacuggagcgguuacaguggaucuuucauggacuauugggcugagggggacugcuaucgagcguguuuuuacguggaguugauacguggaagacccaaggaggauaaagugugguggaccagcaauaguauaguaucgauguguuccaguacagaauuccugggacaaugggacuggccugauggggcuaaaauagaguacuuccucuaa

SEQ ID NO: 54190 - RNA, 1413 nt, Artificial Sequence; identical to SEQ ID NO: 54189
  neuraminidase__InfluenzaA__AGQ81935

SEQ ID NO: 54191 - RNA, 1413 nt, Artificial Sequence; identical to SEQ ID NO: 54189
  neuraminidase__InfluenzaA__AGQ81936

SEQ ID NO: 54192 - RNA, 1413 nt, Artificial Sequence; identical to SEQ ID NO: 54189
  neuraminidase__InfluenzaA__AGQ81937

SEQ ID NO: 54193 - RNA, 1413 nt, Artificial Sequence; identical to SEQ ID NO: 54189
  neuraminidase__InfluenzaA__AGQ81938

SEQ ID NO: 54194 - RNA, 1413 nt, Artificial Sequence; identical to SEQ ID NO: 54189
  neuraminidase__InfluenzaA__AGQ81939

SEQ ID NO: 54195 - RNA, 1413 nt, Artificial Sequence
  neuraminidase__InfluenzaA__AGQ81940
augaauccaaaucagaagauucuaugcacuucagccacugcuaucauaauaggcgcaaucgcaguacucauaggaauagcaaaucuaggguugaacauaggacugcaucuaaaaccgagcugcaauugcucacacucacaaccugaaacaaccaacacaagccaaacaauaauaaacaacuauuauaaugaaacaaacaucacccaaauaaguaacaccaacauccaaauggaagagagagcaagcaaggguuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugaugguaaauccaggaugucaauauguauaucaggaccaaacaacaaugcaucugcaguagugugguacaacagaaggccuguugcagaaauuaacacaugggcccgaaacauacuaagaacacaggaaucugaaugcgugugccacaacgguguaugcccaguaguguucaccgaugggucugccacuggaccugcagacacaagaauauacuauuucaaagagggaaaaauauugaaaugggagucucuggcuggaacugcuaagcauauugaagaaugcucauguuacggggaacgaacaggaauuaccugcacaugcagggacaauuggcagggcucaaauagaccaguaauucagauagauccaguagcaaugacacacacuagucaguauauaugcaguccuguucuuacagacaauccccgaccgaaugacccaaauauagguaaguguaaugacccuuauccagguaauaauaacaauggagucaagggguucucauaccuggauggggccaacacuuggcuagggaggacaauaagcacagccucgaggucuggauacgagaugcuaaaagugccaaaugcauugacagaugauagaucaaagcccauucaaggucagacaauuguauuaaacacugacuggagugguuacaguggaucuuucauggacuauugggcugagggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 54196 - RNA, 1413 nt, Artificial Sequence
  neuraminidase__InfluenzaA__AGQ81941
augaauccaaaucagaagauucuaugcacuucagccacugcuaucauaauaggcacaaucgcagugcucauaggaguagcaaaucuaggguugaacauaggacugcaucuaaaaccggguugcaauugcucacacucacaaccugaagcaaccaacacaagccaaacaauaauaaacaacuauuauaaugaaacaaauaucacccaaauaaguaacacaaacauccaaauggaagagagaccaaacagggguuucaauaacuuaaccaaagggcucuguacuauaaauucauggcacauauaugggaaagacaaugcaguaagaauuggagagaacucagauguuuuaguuacaagagaacccuauguuucaugcgacccagaugaaugcagguucuaugcucucagccaaggaacaacaaucagagggaaacacucaaacggaacaauacacgauaggucccaguaucgcgcucugauaagcuggccacuaucaucaccgcccacaguauacaacagcaggguggaaugcauuggguggucaaguacuaguugccaugauggcaaauccaggaugucaauauguauaucaggaccaaauaacaaugcaucugcaguaguaugguacaacagaaggccuguugcagaaauuaacacaugggcccgaaacauacuaagaacacaggaaucugaauguguaugccacaacgguguaugcccaguaguguucacagaugggucugccacuggaccugcagacacaagaguauacuauuucagagagggaaaaauauugaaaugggaaucucugacuggaacugcuaggcauauugaagaaugcucauguuacggggaacgaacagggauuaccugcacaugcagagacaauuggcagggcucgaauagaccaguaauucagauagauccaguggcaaugacacacacuagucaauacauaugcaguccuguucucacagacaauccccgaccaaaugacccaaauguagguaaguguaacgacccuuauccagguaauaauaacaauggagucaaaggguucucauaccuggauggggucaacacuuggcuagggaggacaauaagcacagcuucgaggucuggauacgagaugcuaaaagugccaaaugcauuaacagaugauaggucaaagcccauucaaggucagacaaucguauuaaacacugacuggagugguuacaguggaucuuucauggacuauugggcugagggggacugcuaucgagcauguuuuuacguggaguugauacgcggaagacccaaggaggauaaagugugguggaccagcaauaguauaguaucgauguguuccaguacagaguuccugggacaaugggacuggccugauggggcuaaaauagaguacuuccucuaa

SEQ ID NO: 54197 - RNA, 1413 nt, Artificial Sequence
  neuraminidase__InfluenzaA__AGQ81942
augaauccaaaucagaagauucuaugcacuucagccacugcuaucauaauaggcacaaucgcagugcucauaggaguagcaaaucuaggguugaacauaggacugcaucuaaaaccggguugcaauugcucacacucacaaccugaagcaaccaacacaagccaaacaauaauaaacaacuauuauaaugaaacaaauaucacccaaauaaguaacacaaacauccaaauggaagagagaccaagcagggguuucaauaacuuaaccaaagggcucuguacuauaaauucauggcacauauauggaaaagacaaugcaguaagaauuggagagaacucagauguuuuaguuacaagagaacccuauguuucaugcgacccagaugaaugcagguucuaugcucucagccaaggaacaacaaucagagggaaacacucaaacggaacaauacacgauaggucccaguaucgcgcucugauaagcuggccacuaucaucaccgcccacaguauacaauagcaggguggaaugcauuggguggucaaguacuaguugccaugauggcaaauccaggaugucaauauguauaucaggaccaaauaacaaugcaucugcaauaguaugguacaacagaaggccuguugcagaaauuaacacaugggcccgaaauauauuaagaacacaggaaucugaauguguaugccacaacgguguaugcccaguaguguucacagaugggucugccacuggaccugcagacacaagaguauacuauuucagagagggaaaaauauugaaaugggaaucucugacuggaacugcuaggcauauugaagaaugcucauguuacggggaacgaacaggaauuaccugcacaugcagagacaauuggcagggcucgaauagaccaguaauucagauagauccaguggcaaugacacacacuagucaguacauaugcaguccuguucucacagacaauccccgaccaaaugacccaaauguagguaaguguaacgacccuuauccagguaauaauaacaauggaguuaaaggguuuucauaccuggauggggucaacacuuggcuagggaggacaauaagcacagcuucgagaucuggauacgagaugcuaaaagugccaaaugcauuaacagaugauaggucaaagcccauucaaggucagacaaucauauuaaacacugacuggagugguuacaguggaucuuucauggacuauugggcugagggggacugcuaucgagcauguuuuuacguggaguugauacgcggaagacccaaggaggauaaagugugguggaccagcaauaguauaguaucgauguguuccaguacagaguuccugggacaaugggacuggccugauggggcuaaaauagaguacuuccucuaa

SEQ ID NO: 54198 - RNA, 1413 nt, Artificial Sequence
  neuraminidase__InfluenzaA__AGQ81943
augaauccaaaucagaagauucuaugcacuucagccacugcuaucauaauaggcgcaaucgcaguacucauagggauagcaaaccuaggguugaacauaggacugcaucuaaaaccgagcugcaauugcucacacucacaaccugaaacaaccaacacaagccaaacaauaauaaacaacuauuauaaugaaacaaacaucacccaaauaaguaacaccaacauccaaauggaagagagaacaagcagggguuucaauaacuuaacuaaagggcucuguacuauaaauucauggcacauauaugggaaagacaaugcaauaagaauuggagagagcucggauguucuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaauagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaaugugugugccacaacggcguaugcccaguaguguucaccgaugggucugccacuggaccugcagacacaagaauauacuauuucaaagaggggagaauauugaaaugggagucucugacuggaacugcuaagcauauugaagaaugcucauguuacggggaacgaacaggaauuaccugcacaugcagggacaauuggcagggcucaaauagaccagugauucagauagauccaguagcaaugacacacacuagucaguauauaugcaguccuguucuuacagacaauccccgaccgaaugacccaaauauagguaaguguaaugacccuuauccagguaauaauaacaauggagucaagggguucucauaccuggauggggcuaacacuuggcuagggaggacaauaagcacagccucgaggucuggauacgagaugcuaaaagugccaaaugcauugacagaugauagaucaaagcccauucaaggucagacaauuguauuaaacacugacuggagugguuacaguggaucuuucauggacuauugggcugagggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 54199 - RNA, 1413 nt, Artificial Sequence; identical to SEQ ID NO: 54189
  neuraminidase__InfluenzaA__AGQ81944

SEQ ID NO: 54200 - RNA, 1413 nt, Artificial Sequence
  neuraminidase__InfluenzaA__AGQ81947
augaauccaaaucagaagauucuaugcacuucagccacugcucucguaauagguacaaucgcaguacucauaggaauagcaaaucuaggguugaauauaggacugcaucuaaaaccgagcugcaauugcucacacucacaaccugaagcaaccaacacaagccaaacaauaauaaacaacuauuacaaugaaacaaauaucacccaaauaagcaacaccaacauucaaauggaagagagagcaagcaggaguuucaauaacuuaacuaaagggcucuguacuauaaacucauggcacauauacgggaaagacaaugcaauaagaauuggagagaacucagauguuuuagucacaagagaacccuauguuucaugcgacccagaugaaugcagguucuaugcucucagccaaggaacaacaaucagagggaaacacucaaauggaacaauacacgauaggucccaguaucgcgcccugauaagcuggccacuaucaucaccgcccacaguauacaauagcaggguggaaugcauuggguggucaagcacuaguugccaugaugguaaauccaggaugucaauaugcauaucaggaccaaacaacaaugcaucugcaguaguaugguacaacagaagaccuguugcagaaauuaacacaugggcccggaacauacuaagaacacaggaaucugaauguguaugccacaacgguguaugcccaguaguguucacagaugggucugccacuggaccugcagacacaagaauauauuauuucaaagagggaaaaauauugaaaugggaaucucugacuggaacugccaagcauauugaggaaugcucauguuacggggaacgaacaggaauuaccugcacauguagagacaauuggcagggcucaaauagaccaguaauucaaauagauccaguggcaaugacacacacuagucaguauauaugcaguccuguucucacagacaauccccgaccaaaugacccaaauguagguaaguguaacgauccuuauccagguaauaauaacaauggagucaaaggguucucauaccuggaugggguuaacacguggcuagggaggacaauaagcacagcuucgaggucuggauaugagaugcuaaaagugccaaaugcauugacagaugauagaucaaagcccauucaaggucaaacaauuguauuaaacacugacuggagugguuacaguggaucuuucauggacuauugggcugagggggacugcuaucgagcguguuucuacguggaguuaauacguggaagacccaaggaggauaaagugugguggaccagcaauaguauaguaucgauguguuccaguacagaauuccugggacaguggaacuggccugauggggcuaaaauagaguacuuccucuaa

SEQ ID NO: 54201 - RNA, 1413 nt, Artificial Sequence
  neuraminidase__InfluenzaA__AGQ81948
augaauccaaaucagaagauucuaugcacuucagccacugcuaucauaauaggcgcaaucgcaguacucauaggaauagcaaaccuaggguugaacauaggacugcaucuaaaaccgagcugcaauugcucacacucacaaccugaaacaaccaacacaagccaaacaauaauaaacaacuauuacaaugaaacaaacaucacccaaauaaguaacaccaacauccaaauggaagagagaacaagcagggguuucaauaacuuaacuaaagggcucuguacuauaaauucauggcacauauaugggaaagacaaugcaauaagaauuggagagagcucggauguuuuagucacaagagaacccuauguuucaugcgacccagaugaaugcagguucuaugcucucagccaaggaacaacaaucagagggaaacauucaaacggaacaauacacgauaggucccaguaucgcgcccugauaagcuggccacuaucaucaccgcccacaguguacaauagcaggguggaaugcauuggauggucaaguacuaguugccaugacggcaaauccaggaugucaauauguauaucaggaccaaacaacaaugcaucugcaguaguaugguacaacagaaggccuguugcagaaauuaacacaugggcccgaaacauacuaagaacacaggaaucugaaugugugugccacaacggcguaugcccaguaguguucaccgaugggucugccacuggaccugcagacacaagaauauacuauuucaaagaggggagaauauugaaaugggagucucugacuggaacugcuaagcauauugaagaaugcucauguuacggggaacgaacaggaauuaccugcacaugcagggacaauuggcagggcucaaauagaccagugauucagauagauccaguagcaaugacacacacuagucaguauauaugcaguccuguucuuacagacaauccccgaccgaaugacccaaacauagguaaguguaaugacccuuauccagguaauaauaacaauggagucaagggguucucauaccuggauggggcuaacacuuggcuagggaggacaauaagcacagccucgaggucuggauacgagaugcuaaaagugccaaaugcauugacagaugauagaucaaagcccauucaaggucagacaauuguauuaaacacugacuggagugguuacaguggaucuuucauggacuauugggcugagggggaaugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 54202 - RNA, 1413 nt, Artificial Sequence
  neuraminidase__InfluenzaA__AGQ81951
augaauccaaaucagaagauucuaugcacuucagccacugcuaucguaauaggcacaaucgcaguacucauaggaguagcaaaucuaggguugaacauagggcugcaucuaaaaccggguugcaauugcucacaaucacaaccugaagcaaccaacacaagccaaacaauaauaaacaacuauuauaaugaaacaaauaucacccaaauaaguaacacgaacauccaaauggaagagagagcaaacagggguuucaacaacuuaaccaaagggcucuguacuauaaauucauggcacauauaugggaaagacaaugcaguaagaauuggagagaacucagauguuuuaguuacaagagaacccuauguuucaugcgauccagaugaaugcagguuuuaugcucucagccaaggaacaacaaucagagggaaacacucaaacggaacaauacacgauaggucccaguaucgcgcucugauaagcuggccacuaucaucaccacccacgguauacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacgguguaugcccaguaguguucacagaugggucugccacuggaccugcagacacaagaguauacuacuucagagagggaaaaauauugaaaugggaaucucugacuggaacugcuaagcauauugaagaaugcucauguuacggggaacgaacaggaauuaccugcacaugcagagacaauuggcagggcucgaauagaccaguaauucagauagauccaguggcaaugacacacacuagucaguacauaugcagcccuguucucacagacaauccccgaccaaaugacccaaauguagguaaguguaacgacccuuauccagguaauaauaacaauggagucaaaggguucucauaccuggauggggucaacacuuggcuagggaggacaauaagcacagcuucgaggucuggauacgagaugcugaaagugccgaaugcauuaacagaugauaggucaaaacccauucaaggucagacaaucguauuaaacacugacuggaguggcuacaguggaucuuucauggacuauugggcugagggggacugcuaucgagcauguuuuuacguggaguugauacgcggaagacccaaggaggauaaagugugguggaccagcaauaguauaguaucgauguguuccaguacagaauuccugggacaauggaacuggccugauggggcuaaaauagaguacuuccucuaa

SEQ ID NO: 54203 - RNA, 1413 nt, Artificial Sequence
  neuraminidase__InfluenzaA__AGQ81952
augaauccaaaucagaagauucuaugcacuucagccacugcuaucguaauaggcacaaucgcaguacucauaggaguagcaaaucuaggguugaacauagggcugcaucuaaaaccggguugcaauugcucacacucacaaccugaagcaaccaacacaagccaaacaauaauaaacaacuauuauaaugaaacaaauaucacccaaauaaguaacacaaacauccaaauggaggagagagcaaacagagguuucaauaacuuaaccaaagggcucuguacuauaaauucauggcacauauaugggaaagacaaugcaguaagaauuggagagaacucagauguuuuaguuacaagagaacccuauguuucaugcgauccagaugaaugcagguucuaugcucucagccaaggaacaacaaucagagggaaacacucaaacggaacaauacacgauaggucccaguaucgcgcucugauaagcuggccacuaucaucaccgcccacaguauacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacgguguaugcccaguaguguucacagaugggucugccacuggaccugcagacacaagaguauacuauuucagagagggaaaaauauugaaaugggaaucccugacuggaacugcuaagcauauugaagaaugcucauguuacggggaacgaacaggaauuaccugcacaugcagagacaauuggcagggcucgaauagaccaguaauucagauagauccaguggcaaugacacacacuagucaguacauaugcaguccuguucucacagacaauccccgaccaaaugacccaaauguagguaaguguaaugacccuuauccagguaauaauaacaauggagucaaaggguucucauaccuggauggggucaacacuuggcuagggaggacaauaagcacagcuucgaggucuggauacgagaugcuaaaagugccaaaugcauuaacagaugauaggucaaagcccauucaaggucagacaaucguauuaaacacugacuggagugguuacaguggaucuuucauggacuauugggcugagggggacugcuaucgagcauguuuuuacguggaguugauacgcggaagacccaaggaggauaaagugugguggaccagcaauaguauaguaucgauguguuccaguacagaauuccugggacaauggaacuggccugauggggcuaaaauagaguacuuccucuaa

SEQ ID NO: 54204 - RNA, 1413 nt, Artificial Sequence
  neuraminidase__InfluenzaA__AGQ81954
augaauccaaaucagaagauucuaugcacuucagccacugcuaucguaauaggcacaaucgcaguacucauaggaguagcaaaucuaggguugaacauaggacugcaucuaaaaccgagcugcaauugcucacacucacaaccugaagcaaccaacacaagccaaacaauaauaaacaacuauuauaaugaaacaaauaucacccaaauaaguaacaccaacauccaaauggaagagagagcaagcagggguuucaauaacuuaaccaaagggcucuguacuauaaauucauggcacauauaugggaaagacaaugcaguaagaauuggagagaacucagauguuuuagucacaagagaacccuauguuucaugcgacccagaugaaugcagguucuaugcucucagccaaggaacaacaaucagagggaaacacucaaacggaacaauacacgauaggucccaguaucgcgcucugauaagcuggccacuaucaucaccgcccacaguauacaacagcaggguggaaugcauuggguggucaaguacuagcugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacgguguaugcccaguaguuuucacagaugggucugccacugggccugcagacacaagaguauacuauuucaaagagggaaaaauauugaaaugggaaucucugacuggaacugcuaagcauauugaagaaugcucauguuacggggaacgaacaggaauuaccugcacaugcagagacaauuggcagggcucaaauagaccaguaauucagauagauccaguggcaaugacacacacuagucaguauauaugcaguccuguucucacagacaauccccgaccgaaugacccaaauguagguaaguguaacgacccuuauccagguaauaauaacaauggagucaaaggguucucauaccuggaugggguuaacacuuggcuagggaggacaauaagcacagcuucgaggucuggauacgagaugcuaaaagugccaaaugcauuaacagaugauaggucaaagcccauucaaggucagacaaucguauuaaacacugacuggagugguuacaguggaucuuucauggacuauugggcugagggggacugcuaucgagcauguuuuuacguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 54205 - RNA, 1413 nt, Artificial Sequence
  neuraminidase__InfluenzaA__AGQ81956
augaauccaaaucagaagauucuaugcacuucagccacugcuaucguaauaggcacaaucgcaguacucauaggaguagcaaaucuaggguugaacauaggacugcaucuaaaaccgagcugcaauugcucacacucacaaccugaagcaaccaacacaagccaaacaauaauaaacaacuauuauaaugaaacaaauaucacccaaauaaguaacaccaacauccaaauggaagagagagcaagcagggguuucaauaacuuaaccaaagggcucuguacuauaaauucauggcacauauaugggaaagacaaugcaguaagaauuggagagaacucagauguuuuagucacaagagaacccuauguuucaugcgacccagaugaaugcagguucuaugcucucagccaaggaacaacaaucagagggaaacacucaaacggaacaauacacgauaggucccaguaucgcgcucugauaagcuggccacuaucaucaccgcccacaguauacaacagcaggguggaaugcauuggguggucaaguacuagcugccaugauggcaaauccaggaugucaauauguauaucaggaccaaacaacaaugcaucugcaauaguaugguacaacagaaggccuguugcagaaauuaacacaugggcccgaaacauacuaagaacacaggaaucugaauguguaugccacaacgguguaugcccaguaguuuucacagaugggucugccacuggaccugcagacacaagaguauacuauuucaaagagggaaaaauauugaaaugggaaucucugacuggaacugcuaagcauauugaagaaugcucauguuacggggaacgaacaggaauuaccugcacaugcagagacaauuggcagggcucaaauagaccaguaauucagauagauccaguggcaaugacacacacuagucaguauauaugcaguccuguucucacagacaauccccgaccgaaugacccaaauguagguaaguguaacgacccuuauccagguaauaauaacaauggagucaaaggguucucauaccuggaugggguuaacacuuggcuagggaggacaauaagcacagcuucgaggucuggauacgagaugcuaaaagugccaaaugcauuaacagaugauaggucaaagcccauucaaggucagacaaucguauuaaacacugacuggagugguuacaguggaucuuucauggacuauugggcugagggggacugcuaucgagcauguuuuuacguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 54206 - RNA, 1413 nt, Artificial Sequence
  neuraminidase__InfluenzaA__AGQ81957
augaauccaaaucagaagauucuaugcacuucagccacugcuaucguaauaggcacaaucgcaguacucauaggaauagcaaaucuaggguugaacauaggacugcaucuaaaaccgagcugcaauugcucacacucacaaccugaagcaaccaacacaagccaaauaauaauaaacaacuauuauaaugaaacaaauaucacccaaguaaguaacaccaacauccaaauggaagaaagggcaagcagagguuucaauaacuuaacuaaagggcucuguacuauaaauucauggcacauauaugggaaagacaaugcaguaagaauuggagagaacucagauguuuuagucacaagagaacccuauguuucaugcgacccagaugaaugcagguucuaugcucucagccaaggaacaacaaucagagggaaacacucaaacggaacaauacacgauaggucccaauaucgcgcccugauaagcuggccacuaucaucaccgcccacaguauacaauagcaggguggaaugcauuggguggucgagcacuaguugccaugauggcaaguccaggaugucaauauguauaucaggaccaaacaacaaugcaucugcaguaguaugguacaacagaaggcccguugcagaaauuaacacaugggcccgaaacauacuaagaacacaggaaucugaauguguaugccacaacggugugugcccaguaguguucacagaugggucugccacuggaccugcagacacaagaauauacuauuucaaagaaggaaaaauacugaaaugggaaucucugacuggaacugcuaagcacauugaagaaugcucauguuacggggaaagaacaggaauuaccugcacaugcagagacaauuggcagggcucaaauagaccaguaauucaaauagauccaguggcaaugacacacacuagccaguauauaugcaguccuguucucacagacaauccccgaccgaaugacccaaauguagguaaguguaacgacccuuauccagguaauaauaacaauggggucaaaggguucucauaccuggauggaguuaacacuugguuagggagaacaauaagcacagcuucgaggucuggauaugagaugcuaaaagugccaaaugcauugacagaugauagaucaaagcccguucaaggucagacgaucguauuaaacacugacuggagcgguuacaguggaucuuucauggacuauugggcugagggagacugcuauagagcguguuucuacguggaguugauacguggaagacccaaggaggauaaagugugguggaccagcaauagcauaguaucaauguguuccaguacagaauuccugggacaauggaacuggccugauggggcuaaaauagaguacuuccucuaa

SEQ ID NO: 54207 - RNA, 1413 nt, Artificial Sequence; identical to SEQ ID NO: 54189
  neuraminidase__InfluenzaA__AGQ81958

SEQ ID NO: 54208 - RNA, 1413 nt, Artificial Sequence; identical to SEQ ID NO: 54189
  neuraminidase__InfluenzaA__AGQ81959

SEQ ID NO: 54209 - RNA, 1413 nt, Artificial Sequence
  neuraminidase__InfluenzaA__AGQ81960
augaauccaaaucagaagauucuaugcacuucagccacugcuaucguaauaggcacaaucgcaguacucauaggaauagcaaaccuaggguuaaacauaggacugcaucuaaaaccgaacugcaauugcucacgcucacaaccugaaacaaccaacacaagccaaacaauaauaaacaacuauuauaaugaaacaaauaucacccaaauaaguaacaccaacauucaaauggaagaaagagcaagcagagauuucaauaacuugacuaaagggcucuguacuauaaauucauggcacauauaugggaaagacaaugcaguaagaauuggagagaacucagauguuuuagucacaagagaacccuauguuucaugcgacccaaaugaaugcagguucuaugcucucagccaaggaacaacaaucagagggaaacacucaaacggaacgauacacgauaggucccaauaccgcgcccugauaagcuggccacuaucaucaccgcccacaguauacaauagcaggguggaaugcauuggguggucaaguacuaguugccaugauggcaaguccaggaugucaauauguauaucaggaccaaacaacaaugcaucugcaguaguaugguacaacagaagaccuguugcagaaauuaacacaugggcccgaaacauacuaagaacacaggaaucugaauguguaugccacaacgguguaugcccaguaguguucacagaugggucugccacuggaccugcagacacaagaauauacuauuucaaagagggaaaaauauugaaaugggaaucucugacuggaacugcuaagcauauugaagaaugcucauguuacggggaacgaacagaaauuaccugcacaugcagagacaauuggcagggaucaaauagaccaguaauccagauagauccaguggcaaugacacauacuagucaguauauaugcagcccuguucucacagacaauccccggccgaaugacccaaauguagguaaguguaacgacccuuauccagguaauaauaacaauggagucaaaggguucucauaccuagauggagucaacacuuggcuagggagaacaauaagcacagcuucgaggucuggguaugagaugcuaaaagugccaaaugcauugacagaugauagaucaaagcccauucaaggucagaccauuguauuaaacacugacuggagcgguuacaguggaucuuucauggacuauugggcugagggggacugcuaucgagcguguuuuuacguggaguugauacguggaagacccaaggaggauaaagugugguggaccagcaauaguauaguaucgauguguuccaguacagaauuccugggacaaugggacuggccugauggggcuaaaauagaguacuuccucuaa

SEQ ID NO: 54210 - RNA, 1413 nt, Artificial Sequence
  neuraminidase__InfluenzaA__AGQ81961
augaauccaaaucagaagauucuaugcacuucagccacugcuaucguaauaggcacaaucgcaguacucauaggaguagcaaaucuaggguugaacauagggcugcaucuaaaaccggguugcaauugcucacaaucacaaccugaagcaaccaacacaagccaaacaauaauaaacaacuauuauaaugaaacaaauaucacccaaauaaguaacacgaacauccaaauggaagagagagcaaacagggguuucaacaacuuaaccaaagggcucuguacuauaaauucauggcacauauaugggaaagacaaugcaguaagaauuggagagaacucagauguuuuaguuacaagagaacccuauguuucaugcgauccagaugaaugcagguuuuaugcucucagccaaggaacaacaaucagagggaaacacucaaacggaacaauacacgauaggucccaguaucgcgcucugauaagcuggccacuaucaucaccacccacgguauacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacgguguaugcccaguaguguucacagaugggucugccacuggaccugcagacacaagaguauacuacuucagagagggaaaaauauugaaaugggaaucucugacuggaacugcuaagcauauugaagaaugcucauguuacggggaacgaacaggaauuaccugcacaugcagagacaauuggcagggcucgaauagaccaguaauucagauagauccaguggcaaugacacacacuagucaguacauaugcagcccuguucucacagacaauccccgaccaaaugacccaaauguagguaaguguaacgacccuuauccagguaauaauaacaauggagucaaaggguucucauaccuggauggggucaacacuuggcuagggaggacaauaagcacagcuucaaggucuggauacgagaugcugaaagugccgaaugcauuaacagaugauaggucaaaacccauucaaggucagacaaucguauuaaacacugacuggaguggcuacaguggaucuuucauggacuauugggcugagggggacugcuaucgagcauguuuuuacguggaguugauacgcggaagacccaaggaggauaaagugugguggaccagcaauaguauaguaucgauguguuccaguacagaauuccugggacaauggaacuggccugauggggcuaaaauagaguacuuccucuaa

SEQ ID NO: 54211 - RNA, 1413 nt, Artificial Sequence; identical to SEQ ID NO: 54202
  neuraminidase__InfluenzaA__AGQ81962

SEQ ID NO: 54212 - RNA, 1413 nt, Artificial Sequence
  neuraminidase__InfluenzaA__AGQ81963
augaauccaaaucagaagauucuaugcacuucagccacugcuaucguaauaggcacaaucgcaguacucauaggaauagcaaaucuaggguugaacauaggacugcaucuaaaaccgagcuguaauugcucacacucacaaccugaagaaaccaacacaagccaaacaauaauaaacaacuauuauaaugaaacaaauaucacacaaauaaguaauaccaacauucaaauggaagaaagagcaagcagggguuuuaauaacuuaacuaaagggcucuguacuauaaauucauggcacauauaugggaaagacaaugcaguaagaauuggagagaacucagauguuuuagucaccagggaacccuauguuucaugcgacccaaaugaaugcagauucuaugcucucagccaaggaacaacaaucagagggaaacacucaaacgggacaauacacgauaggucccaauaucgcgcccugauaagcuggccacuaucaucaccgcccacgguauacaauagcaggguggaaugcauuggguggucaaguacuaguugccaugacggcaaguccaggaugucaguauguauaucaggaccaaacgacaaugcaucagcaguaguaugguacaacagaaggccuguugcagaaauuaacacaugggcccgaaacauacuaagaacacaggaaucugaauguguaugccauaacgguguaugcccaguaguguucacagaugggucugccacuggaccugcacacacaagaauauacuauuucaaagagggaaaaauauugaaaugggaaucucugacuggaacugccaagcauauugaagaaugcucauguuacggggaacgaacaggaauuaccugcacaugcagagacaauuggcagggcucaaauagaccaguaauucagauagauccaguggcaaugacacacacuagucaguauauaugcaguccuguucucacagacaacccccgaccgaaugacccaaauguagguaaguguaacgacccuuauccagguaauaauaacaauggagucaaaggguucucauaccuggauggaguuaacacuuggcuagggagaacaauaagcacagcuucgaggucuggauaugagaugcuaaaagugccaaaugcauugacagaugauagaucaaagcccauucaaggucagacaaucguauuaaacacugacuggagugguuacaguggaucuuucauggacuauuggacugagggggacugcuaucgagcguguuuuuacguagaguugauacguggaagacccaaggaggauaaagugugguggaccagcaauaguauaguaucgauguguuccaguacagaauuccugggacaaugggacuggccugauggggcuaaaauagaguacuuccucuaa

SEQ ID NO: 54213 - RNA, 1413 nt, Artificial Sequence
  neuraminidase__InfluenzaA__AGQ81964
augaauccaaaccagaagauucuaugcaccucagccacugcuaucguaauaggcacgauugcaguacucauagggauagcaaaucuaggguugaacauaggacugcaucuaaaaccgagcugcaauugcucacacucaaaaccugaggaaacuaaugcaagccaaacaauaauaaacaacuauuauaaugaaacaaauaucacccaaauaaguaacaccaacauccaaauggaagagagagcaagcagggguuucaauaacuuaacuaaagggcucuguacuauaaauucauggcacauauaugggaaagacaaugcaguaagaauuggagagagcucagauguucuggucacaagagaacccuauguuucaugcgacccagaugaaugcagguucuaugcucucagccaagggacaacaaucagagggaaacacucaaacggaacaauacacgauaggucccaguaucgcgcccugauaagcuggccacuaucaucaccgcccacaguauacaacagcaggguggaauguauuggguggucaaguacuaguugccaugauggcaaauccaggaugucaauauguauaucaggaccaaauaauaaugcaucugcaguagucugguacaacagaagaccuguugcagagauuaacacaugggcccgaaacauccuaagaacacaggaaucugaauguguaugccacaacgguguaugcccaguaguguucacagaugggucugccacuggaccugcagacacaagaauauacuauuucaaagaagggaaaauauugaaaugggaaucucugacuggaacugcuaagcauauugaagaaugcucauguuacggggaacgaacagggauuacuugcacaugcagagauaauuggcagggcucaaauagaccaguaauucagauagauccaguggcaaugacacacaccagucaguauauaugcaguccuguucucacagacaauccccgaccgaaugacccaaauguagguaaguguaacgacccuuacccagguaauaauaacaauggggucaaaggauucucauaccuggaugggguuaacacuuggcuagggaggacaacaagcacaacuucaaggucuggauacgagaugcuaaaggugccaaaugcauugacagaugauagaucaaagcccauccaaggucaaacaaucguauuaaacacugacuggaguggguacagugggucuuucauggauuauugggcugagggggacugcuaucgagcguguuuuuacguggaauugauacguggaagaccuaaggaagauaaagugugguggaccagcaauagcauaguaucgauguguuccaguacagaauuccugggacaauggaauuggccugauggggcuaaaauagaguacuuccucuaa

SEQ ID NO: 54214 - RNA, 1413 nt, Artificial Sequence
  neuraminidase__InfluenzaA__AGQ81966
augaauccaaaucagaggauucuaugcacuucagccacugcuaucguaauaggcacaaucgcaguacucauaggaguagcaaaucuaggguugaacauagggcugcaucuaaaaccggguugcaauugcucacacucacaaccugaagcaaccaacacaagccaaacaauaauaaacaacuauuauaaugaaacaaauaucacccaaauaaguaacacaaacauccaaauggaggagagagcaaacagagguuucaauaacuuaaccaaagggcucuguacuauaaauucauggcacauauaugggaaagacaaugcaguaagaauuggagagaacucagauguuuuaguuacaagagaacccuauguuucaugcgauccagaugaaugcagguucuaugcucucagccaaggaacaacaaucagagggaaacacucaaacggaacaauacacgauaggucccaguaucgcgcucugauaagcuggccacuaucaucaccgcccacaguauacaacagcaggguggaaugcauuggguggucaaguacuaguugccaugauggcaaauccaggaugucgauauguauaucaggaccaaacaacaaugcaucugcaguaguaugguacaacagaaggccuguugcagaaauuaacacaugggcccgaaacauacuaagaacacaggaaucugaauguguaugccacaacgguguaugcccaguaguguucacagaugggucugccacuggaccugcagacacaagaguauacuauuucagagagggaaaaauauugaaaugggaaucccugacuggaacugcuaagcauauugaagaaugcucauguuacggggaacgaacaggaauuaccugcacaugcagagacaauuggcagggcucgaauagaccaguaauucagauagauccaguggcaaugacacacacuagucaguacauaugcaguccuguucucacagacaauccccgaccaaaugacccaaauguagguaaguguaaugacccuuauccagguaauaauaacaauggagucaaaggguucucauaccuggauggggucaacacuuggcuagggaggacaauaagcacagcuucgaggucuggauacgagaugcuaaaagugccaaaugcauuaacagaugauaggucaaagcccauucaaggucagacaaucguauuaaacacugacuggagugguuacaguggaucuuucauggacuauugggcugagggggacugcuaucgagcauguuuuuacguggaguugauacgcggaagacccaaggaggauaaagugugguggaccagcaauaguauaguaucgauguguuccaguacagaauuccugggacaauggaacuggccugauggggcuaaaauagaguacuuccucuaa

SEQ ID NO: 54215 - RNA, 1413 nt, Artificial Sequence
  neuraminidase__InfluenzaA__AGQ81967
augaauccaaaucagaagauucuaugcacuucagccacugcuaucguaauaggcauaauugcaguacucauagggauagcaaaucugggguugaacauagggcuacaucuaaaaccgagcugcaauugcucacacucacaaccugaagcaaccaaugcgagccaaacaauaauaaacaacuauuauaaugaaacaaacaucacccaaauaaguaacaccaacauccaaauggaagagagagcaagcagggguuucaauaacuuaacuaaagggcucuguacuauaaauucauggcauauauaugggaaagacaaugcaguaagaauuggagagaacucagacguuuuagucacaagagaacccuauguuucaugcgacccagaugaaugcagguucuaugcucucagccaagggacaacaaucagagggaaacauucaaacggaacaauacacgauaggucccaguaucgcgcccugauaagcuggccacuaucaucaccgcccacaguauacaacagcagaguggaaugcauuggauggucaaguacuaguugccaugauggcaaauccaggaugucaauauguauaucaggaccaaacaacaaugcaucugcaguagucugguacaacagaagaccuguugcagaaauuaacacaugggcccgaaacauacuaagaacacaggaaucugaaugcguaugccacaacgguguaugcccagugguguucacagaugggucugcaacuggaccugcagaaacaagaauauacuacuucaaagaggggaaaauauugaaaugggaaucucugacuggaacugcuaagcauauugaagaaugcucauguuacggggaacgaacaggaauuacuugcacaugcagagauaauuggcaaggcucaaauagaccagugauucagauagauccaguggcgaugacacacacuagucaguauauaugcagcccuguucucacagacaauccucgaccgaaugacccaaauguagguaaguguaaugacccuuauccagguaauaacaacaauggagucaaaggguucucauaccuggaugggguuaacacuuggcuagggaggacaauaagcacagcuucaaggucuggauacgaaaugcuaaaggugccaaaugcauugacagaugauagaucaaagcccauccaaggucagauaauaguauuaaacacugacuggagugguuacaguggaucuuucauggacuacugggcugagggggacugcuaucgagcguguuuuuacguggaguugauacgggggagacccaaggaggauaaagugugguggaccagcaauagcauaguaucgauguguuccaguacagaauuccugggacaauggaacuggccugauggggcuaaaauagaguacuuccucuaa

SEQ ID NO: 54216 - RNA, 1413 nt, Artificial Sequence
  neuraminidase__InfluenzaA__AGQ81968
augaauccaaaucagaagauucuaugcacuucagccacugcuaucguaauaggcauaauugcaguacucauaggaauagcaaaucugggguugaacauagggcuacaucuaaaaccgagcugcaauugcucacacucacaaccugaagcaaccaaugcgagccaaacaauaauaaacaacuauuauaaugaaacaaacaucacccaaauaaguaacaccaacauccaaauggaagagagagcaagcagggguuucaauaacuuaacuaaagggcucuguacuauaaauucauggcauauauauggaaaagacaaugcaguaagaauuggagagaacucagacauuuuagucacaagagaacccuauguuucaugcgacccagaugaaugcagauucuaugcucucagccaagggacaacaaucagagggaaacauucaaacggaacaauacacgauaggucccaguaucgcucccugauaagcuggccacuaucaucaccgcccacaguauacaacagcaggguggaaugcauuggguggucaaguacuaguugccaugauggcaaauccaggaugucaauauguauaucaggaccaaacaacaaugcaucugcaguagucugguacaacagaagaccuguugcagaaauuaacacaugggcccgaaacauacuaagaacacaggaaucugaaugcguaugccacaacgguguaugcccagugguguucacagaugggucugccacuggaccugcagaaacaagaauauacuacuucaaagaggggaaaauauugaaaugggaaucucugacuggaacugcuaagcauauugaagaaugcucauguuacggggaacgaacaggaauuacuugcacaugcagagauaauuggcaaggcucaaauagaccaguaauucagauagauccaguggcgaugacacacacuagucaguauauaugcagcccuguucucacagacaauccucgaccgaaugacccaaauguagguaaguguaaugacccuuauccagguaauaacaacaauggagucaaaggguucucauaccuggaugggguuaacacuuggcuagggaggacaauaagcacagcuucaaggucuggauacgaaaugcuaaaggugccaaaugcauugacagaugauagaucaaagcccauccaaggucagacaauaguauuaaacacugacuggagugguuacaguggaucuuucauagacuacugggcugagggggacugcuaucgagcguguuuuuacguggaguugauacgggggagacccaaggaggauaaagugugguggaccagcaauagcauaguaucgauguguuccaguacagaauuccugggacaauggaacuggccugauggggcuaaaauagaguacuuccucuaa

SEQ ID NO: 54217 - RNA, 1413 nt, Artificial Sequence
  neuraminidase__InfluenzaA__AGQ81969
augaauccaaaucagaagauucuaugcacuucagccacugcuaucguaauaggcauaauugcaguacucauagggauagcaaaucugggguugaacauagggcuacaucuaaaaccgagcugcaauugcucacacucacaaccugaagaaaccaaugcgagccaaacaauaauaaacaacuauuauaaugaaacaaacaucacccaaauaaguaacaccaacauccaaauggaagagagagcaagcagggguuucaauaacuuaacuaaagggcucuguacuauaaauucauggcauauauaugggaaagacaaugcaguaagaauuggagagaacucagacguuuuagucacaagagaacccuauguuucaugcgacccagaugaaugcagauucuaugcucucagccaagggacaacaaucagagggaaacauucaaacggaacaauacacgauaggucccaguaucgcgcccugauaagcuggccacuaucaucaccacccacaguauacaacagcagaguggaaugcauuggauggucaaguacuaguugccaugauggcaaauccaggaugucaauauguauaucaggaccaaacaacaaugcaucugcaguagucugguacaacagaagaccuguugcagaaauuaacacaugggcccgaaacauacuaagaacacaggaaucugaaugcguaugccacaacgguguaugcccagugguguucacagaugggucugcaacuggaccugcagaaacaagaauauacuacuucaaagaggggaaaauauugaaaugggaaucucugacuggaacugcuaagcauauugaagaauguucauguuacggggaacgaacaggaauuacuugcacaugcagagauaauuggcaaggcucaaauagaccagugauucagauagauccaguggcgaugacacacacuagucaguauauaugcagcccuguucucacagacaauccucgaccgaaugacccaaauguagguaaguguaaugacccuuauccagguaauaacaacaauggagucaaaggguucucauaccuggaugggguuaacacuuggcuagggaggacaauaagcacagcuucaaggucuggauacgaaaugcuaaaggugccaaaugcauugacagaugauagaucaaagcccauccaaggucagauaauaguauuaaacacugacuggagugguuacaguggaucuuucauggacuacugggcugagggggacugcuaucgagcguguuuuuacguggaguugauacgggggagacccaaggaggauaaagugugguggaccagcaauagcauaguaucgauguguuccaguacagaauuccugggacaauggaacuggccugauggggcuaaaauagaguacuuccucuaa

SEQ ID NO: 54218 - RNA, 1413 nt, Artificial Sequence
  neuraminidase__InfluenzaA__AGQ81970
augaauccaaaucagaagauucuaugcaccucagccaccgcuaucguaauaggcacgauugcaguacucauaggaauagcaaaucuaggguugaacauaggacugcaucuaaaaccgagcugcaauugcucacacucacaaccugaggaaaccaaugcaagccaaacaauaauaaacaacuauuauaaugaaacaaauaucacccagauaagcaacaccaacauucaaauggaagagagagcaagcagggguuucaauaacuuaaccaaagggcucuguacuauaaauucauggcacauauacgggaaagacaaugcaguaagaauuggagaaaacucagauguucuggucacaagagaacccuauguuucaugcgacccagaugaaugcagguucuaugcucucagccaagggacaacaaucagagggaaacacucaaacggaacaauacaugauaggucccaguaucgcgcccugauaagcuggccacuaucaucaccgcccacaguauacaacagcaggguggaauguauuggguggucaaguacuaguugccaugauggcaaauccaggaugucaauauguauaucaggaccaaauaauaaugcaucugcaguagucugguacaacaaaaggccuguugcagaaauuaacacaugggcccgaaacauccuaagaacacaggaaucugaauguguaugccacaacgguguauguccuguaguguucacagaugggucugccacuggaccugcagacacaagaauauacuauuucaaagagggaaaaauauugaaaugggaaccucugacuggaacugccaagcauauugaagaaugcucauguuacggggaacgaacagggauuacuugcacaugcagagauaauuggcagggcucaaauagaccaguaauucagauagauccaguggcaaugacacacacuagccaguauaucugcaguccuguucucacagacaauccccgaccgaaugacccaaauguagguaaguguaaugacccuuacccagguaauaguaacaauggggucaaaggguucucauaccuggaugggguuaacacuuggcuggggaggacaauaagcacagcuucaaggucuggauacgagaugcuaaaggugccaaaugcauugacagaugauagaucaaagccuauccaaggccaaacaaucguauuaaacacugacuggaguggguacagugggucuuucauggacuauugggcugaaggggacugcuaucgagcguguuuuuacguggaauugauacguggaagaccuaaggaagauaaagugugguggaccagcaauagcauaguaucgauguguuccaguacagaauuccugggacaauggaacuggccugauggggcuaaaauagaguacuuccucuaa

SEQ ID NO: 54219 - RNA, 1413 nt, Artificial Sequence
  neuraminidase__InfluenzaA__AGQ81971
augaauccaaaucagaagauucuaugcacuucagccacugcuaucauaauaggcgcaaucgcaguacucauaggaauagcaaaccuaggguugaacauaggacugcaucuaaaaccgagcugcaauugcucacacucacaaccugaaacaaccaacacaagccaaacaauaauaaacaacuauuauaaugaaacaaacaucacccaaauaaguaacaccaacauccaaauggaagagagaacaagcagggguuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaguagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaaugugugugccacaacggcguaugcccaguaguguucaccgaugggucugccacuggaccugcagacacaagaauauacuauuucaaagaggggaaaauauugaaaugggagucucugacuggaacugcuaagcauauugaagaauguucauguuacggggaacgaacaggaauuaccugcacaugcagggacaacuggcagggcucaaauagaccagugauucagauagauccaguagcaaugacacacacuagucaguauauaugcaguccuguucuuacagacaauccccgaccgaaugacccaaauauagguaaguguaaugacccuuauccagguaauaauaacaauggagucaagggguucucauaccuggauggggcuaacacuuggcuagggaggacaauaagcacagccucgaggucuggauacgagaugcuaaaagugccaaaugcauugacagaugauagaucaaagcccauucaaggucagacaauuguauuaaacacugacuggagugguuacaguggaucuuucauggacuauugggcugagggggacugcuaucgagcguguuuuuauguggaguugauacguggaagacccaaagaggauaaagugugguggaccagcaauaguauaguaucgauguguuccaguacagaauuccugggacaauggaacuggccugauggggcuaaaauagaguacuuccucuaa

SEQ ID NO: 54220 - RNA, 1413 nt, Artificial Sequence
  neuraminidase__InfluenzaA__AGQ81972
augaauccaaaucagaagauucuaugcacuucagccacugcuaucauaauaggcgcaaucgcaguacucauaggaauagcaaaucuaggguugaacauaggacugcaucuaaaaccgagcugcaauugcucacacucacaaccugaaacaaccaacacaagccaaacaauaauaaacaacuauuauaaugaaacaaacaucacccaaauaaguaacaccaacauccaaauggaagagagagcaaguagggguuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccagggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugaugguaaauccaggaugucaauauguauaucaggaccaaacaacaaugcaucugcaguaguaugguacaacagaaggccuguugcagaaauuaacacaugggcccgaaacauacuaagaacacaggaaucugaaugcgugugccacaacgguguaugcccaguaguguucaccgaugggucugccacuggaccugcagacacaagaauauacuauuucaaagagggaaaaauauugaaaugggagucucugacuggaacugcuaagcauauugaagaaugcucauguuacggggaacgaacaggaaucaccugcacaugcagggacaauuggcagggcucaaauagaccaguaauucaaauagauccaguagcaaugacacacacuagucaguauauaugcaguccuguucuuacagacaauccccggccgaaugacccaaauauagguaaguguaaugacccuuauccagguaauaauaacaauggagucaagggguucucauaccuggauggggcuaacacuuggcuagggaggacaauaagcacagccucgaggucuggauacgagaugcuaaaagugccaaaugcauugacagaugauagaucaaagcccauucaaggucagacaauuguauuaaacacugacuggagugguuacaguggaucuuucauggauuauugggcugagggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 54221 - RNA, 1413 nt, Artificial Sequence
  neuraminidase__InfluenzaA__AGQ81973
augaauccaaaucagaagauucuaugcacuucagccacugcuaucauaauaggcgcaaucgcaguacucauaggaauagcaaaccuaggguugaacauaggacugcaucuaaaaccgagcugcaauugcucacacucacaaccugaaacaaccaacacaagccaaacaauaauaaacaacuauuauaaugaaacaaacaucacccaaauaaguaacaccaacauccaaauggaagagagaacaagcagggguuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaauagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaaugugugugccacaacggcguaugcccaguaguguucaccgaugggucugccacuggaccugcagacacaagaauauacuauuucaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagauccaguagcaaugacacacacuagucaguauauaugcaguccuguucuuacagacaauccccgaccgaaugacccaaauauagguaaguguaaugacccuuauccagguaauaauaacaauggagucaagggguucucauaccuggauggggcuaacacuuggcuagggaggacaauaagcacagccucgaggucuggauacgagaugcuaaaagugccaaaugcauugacagaugauagaucaaagcccauucaaggucagacaauuguauuaaacacugacuggagugguuacaguggaucuuucauggacuauugggcugagggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 54222 - RNA, 1413 nt, Artificial Sequence; identical to SEQ ID NO: 54202
  neuraminidase__InfluenzaA__AGQ81974

SEQ ID NO: 54223 - RNA, 1398 nt, Artificial Sequence
  neuraminidase__InfluenzaA__AGQ81975
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaauggcucuguacuauaaauucauggcacauauaugggaaagacaaugcaguaagaauuggagagaacucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaagggaaaauauugaaaugggagucucugacuggaacugcuaagcauauugaagaaugcucauguuacggggaaagaacaggaauuaccugcacaugcagggacaauuggcagggcucaaauagaccagugauucagauagacccaguagcaaugacacacacuagucaauauauaugcaguccuguucuuacagacaauccccgaccggaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugacggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 54224 - RNA, 1398 nt, Artificial Sequence
  neuraminidase__InfluenzaA__AGQ81977
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaauagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuaacagacaauccccgaccggaugacccaaauauagguaaauguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugacggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 54225 - RNA, 1398 nt, Artificial Sequence
  neuraminidase__InfluenzaA__AGQ81979
augaauccaaaucagaagauucuaugcacuucagccacugcuaucauaauaggcgcaaucgcagcacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuaacagacaauccccgaccggaugacccaaauauagguaaauguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugacggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 54226 - RNA, 1398 nt, Artificial Sequence
  neuraminidase__InfluenzaA__AGQ81980
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuaacagacaauccccgaccggaugacccaaauauagguaaauguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugacggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 54227 - RNA, 1350 nt, Artificial Sequence
  neuraminidase__InfluenzaA__AGQ88501
augaauccaaaucagaagauaguaaccauuggaucaaucuguaugguaauuggaauagucagcuugauguuacagauugggaacaugaucucaauaugggucagucauucaauucaaacagggaaucaacaccaaacugaaccaaucagaaauacuaauuuucuuacugagaacgcuguggcuucaguagcauuaucuggcaauucaucucuuugccccauuagaggaugggcuguacacaguaaagacaacaguauaaggauuggguccaaaggggauguguuuguaauuagagagccguucaucucaugcuccaaucuggaaugcagaacuuucuuuuugacucagggagcuuuacugaaugacaagcacuccaacgggacugucaaagacaggagcccucacagaacgcuaaugaguuguccuauaggugaggcccccuccccauacaacucgagguuugagucuguugcuuggucggcaagugcuugccaugauggcaucaguugguugacaauuggaauuucugguccagacaauggggcuguggcgguauugaaauacaauggcauaauaacagacacuaucaagaguuggaggaauaacauacugaggacccaagagucugaauguacauguguaaauggcucuugcuuuacugugaugacagauggaccaaguaauggacaggcaucauauaagauuuucaaaauagaaaaagggaaaguaguuaagucagucgaauugaacgcuccuaauuaucacuaugaggaaugcuccuguuauccugaugcuggcgaaaucauaugugugugcagggauaauuggcauggcucaaacaggccauggguaucuuucaaucagaauuuggaguaucaaauaggauauauuugcaguggaguuuucggagacaauccacgaccaaaugauggggaagguaguugugguccaguguccccuaacggggcauaugggguaaaaggguuuucauuuaaauacggcaauggugucuggaucgggaggaccaaaagcacucauuccaggagcggcuuugaaaugauuugggauccaaauggguggacuggaacggacagugaauuuucgaugaaacaagauauaguagcaauaacugauuggucaggauauagcgggaguuuuguccagcacccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 54228 - RNA, 1401 nt, Artificial Sequence
  neuraminidase__InfluenzaA__AGR33906
augaauccaaaucagaagauacuagcaauuggcucuguuucucuaaccauugcgauaauauguuuccucaugcagauugccaucuuaacaacgacuaugacccuacauuucaagcaaaaugaaugcagcaacccaucaaauaaucaaguggugccaugugaaccaauccuaauagagaggaacacagugcauuugaauaguacuaccauagagaaggaaguuuguccuaaaguggcagaauacaagaauuggucaaaaccacaaugucaaauuacuggguucgcuccuuucucaaaggacaacucaauuaggcuuucugcagguggagauaucuggguaacaagagagccuuauguuucaugcagucuuggcaaauguuaucaauuugcacuugggcagggaaccacccugaaaaacaagcacucaaauggcaccacacaugauagaacuccucacagaacucuuuuaaugaaugaauuaggugucccauuccauuugggaaccaaacaagugugcauagcauggucuaguucaaguugcuaugauggaaaagcaugguuacauauuuguguuacuggggacgauaaaaaugccacugcuaguaucauuuaugaugggaugcuuguugacaguauugguucaugguccaaaaacauccucagaacccaggagucagaaugcguuugcaucaauggaacuugugcaguaguaaugacugauggaagugcaucaggaaaggcugacacuagaauauuauucauaagggaggggaaaauuguaaacauuagcccauugucagggagugcucagcacguugaggaaugcuccuguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauagcuucagcagcagcaauugcagagacccuaauaacgaaagaggggccccaggagugaaaggaugggccuuugacgaugguaaugauguuuggaugggacgaacaaucagaaaugauucacgcucagguuaugagacuuuuaggguagucaaugguuggaccacggcuaauucaaagucacaaauaaauaggcaagucauaguugacagugaaagcuggucuggguauucugguaucuucucuguugaaggcaaaaacugcaucaacagguguuuuuauguggaguugauaagagggagaccacaggagccuagagugugguggacuucaaauagcaucauuguauucuguggaaccucagguacauauggaacaggcucauggccugauggagcgaauaucaacuucaugccuauauaa

SEQ ID NO: 54229 - RNA, 1401 nt, Artificial Sequence
  neuraminidase__InfluenzaA__AGR33908
augaauccaaaucagaagauaacagcaauuggcucuguuucucuaaucauugcgauaauaugucuccucaugcaaauugccaucuuaacaacgacuaugacauuacauuucagacagaaugaaugcaguaacccaucgaauaaucaagugaugccaugugaaccgaucauaauagagaggaacacagugcauuugaauaguacuaccauagagagggaaauuuguccuaaaguagcagaauacaagaauuggucaaaaccacaaugucaaauuacaggguucgcuccuuucucaaaggacaacucaauuaggcuuucugcagguggggauaucugggugacaagagaaccuuaugucucaugcagucccgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauuggcucaugguccaaaaacauccucagaacucaggagucagaaugcguuugcaucaauggaacuugugcagugguaaugaccgauggaagugcaucaggagaggccgacacuagaauauuauucauaagagaaggaaaaauuauaaauaucagcccauugucaggaagugcucagcacguugaggaaugcuccuguuauccccgguauccugaaguuagguguguuugcagagacaauuggaagggcuccaauaggcccauuauauauauaaacaugguugauuauagcauugagucccguuaugugugcucaggacuuguuggcgacacaccaagaaaugaugauagcaccagcagcagcaauugcagagacccuaauaacgaaagaggggccccaggagugaaagggugggccuuugacgacgggaaugauguuuggaugggacggacaaucaaaaauggcucacgcucagguuaugagacuuuuagggucaucaacgguuggaccauggcuaauucaaagucacagauaaauaggcaagucauaguugacagugacaacuggucuggguauuccggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcggauaucaacuucaugccuauauaa

SEQ ID NO: 54230 - RNA, 1401 nt, Artificial Sequence
  neuraminidase__InfluenzaA__AGR33910
augaauccaaaucagaagauaauagcaauuggcucuguuucucuaaccauugcgauaauauguuuccucaugcagauugccaucuuaacaacgacuaugacccuacauuucaagcaaaaugaaugcagcaaaccaucaaauaaucaaguggugccaugugaaccgauccuaauagagaggaacacagugcauuugaauaguacuaccauagagaaggaaguuuguccuaaaguggcagaauacaagaauuggucaaaaccacaaugucaaauuacaggguucgcuccuuucucaaaggacaacucaauuaggcuuucugcagguggagauaucuggguaacaagagaaccuuauguuucaugcaguuuuggcaaauguuaucaauuugcacuugggcagggaaccacccugaaaaacaagcacucaaauggcaccacacaugauagaacuccucacagaacucuuuuaaugaaugaguuaggugucccauuucauuugggaaccaaacaaguaugcauagcauggucuaguucaaguugcuaugauggaaaagcaugguuacauauuuguguuacuggggacgauaaaaaugcuacugcuaguaucauuuaugaugggaugcuuguugacaguauugguucaugguccaaaaacauccucagaacccaggagucagaaugcguuugcaucaauggaacuugugcaguaguaaugacugauggaagugcuucaggaaaggcugacacuagaauauuauucauaagagaggggaaaauuauaaacauuaggccauugucagggagugcucagcacguugaggaaugcuccuguuacccccgguauccugaaguuagguguguuugcagagacaauuggaaaggcuccaauaggcccguucuauauauaaauauggcagauuauaguguugaguccaguuaugugugcucaggacuuguuggcgacacaccaagaaaugaugauaguuccagcagcagcaauugcagagacccuaauaacgaaagaggggccccaggagugaaaggaugggccuuugacgaugguaaugauguuuggaugggacgaacaaucagaaaugauucacgcucagguuaugagacuuuuaggguagucaaugguuggaccacggcuaacucaaagucacaaauaaauaggcaagucauaguugacagugaaaacuggucuggguauucugguaucuucucuguugaaggaaaaaacugcauaaacagguguuuuuauguggaguugauaagagggagaccacaggagccuagagugugguggacuucaaauagcaucauuguauucuguggaaccucagguacauauggaacaggcucauggccugauggagcgaauaucaacuucaugccuauauaa

SEQ ID NO: 54231 - RNA, 1401 nt, Artificial Sequence
  neuraminidase__InfluenzaA__AGR33911
augaauccaaaucagaagauaauagcaauuggcucuguuucucuaaccauugcgauaauaugcuuccucaugcagauugccaucuuaacaacgacuaugacacuacauuucaagcaaaaugaaugcagcaacccaucaaauaaucaaguggugccaugugaaccgauccuaauagagaggaacacagugcauuugaauaguacuaccauagagaaggaaguuuguccuaaaguggcagaauacaagaauuggucaaaaccacaaugucaaauuacaggguucgcuccuuucucaaaggacaacucaauuaggcuuucugcagguggagauaucuggguaacaagagaaccuuauguuucaugcagucuuggcaaauguuaucaauuugcacuugggcagggaaccacccugaaaaacaaucacucaaauggcaccacacaugauagaacuccucacagaacucuuuuaaugaaugaguuaggugucccauuucauuugggaaccaaacaagugugcauagcauggucuaguucaaguugcuaugauggaaaagcaugguuacauauuuguguuacuggggaugauaaaaaugcuacugcuaguauuauuuaugaugggaugcuuguugacaguauugguucaugguccaaaaacauccucagaacccaggagucagaaugcguuugcaucaauggaacuugugcaguaguaaugacugaugggagugcaucaggaaaggcugacacuagaauauuauucauaagagaggggaaaauuauaaacauuagcccauuaucagggagugcucagcauguugaggaaugcucauguuauccccgguauccugaaguuagguguguuugcagagacaauuggaaaggcuccaauaggcccguucuauauauaaauauggcagauuauaguauugaguccaguuaugugugcucaggacuuguuggcgacacaccaagaaaugaugauagcuccagcagcagcaauugcagagacccuaauaacgaaagaggggccccaggagugaaaggaugggccuuugacgaugguaaugauguuuggaugggacgaacaaucagaaauaauucacgcucagguuaugagaccuuuaggguagucaaugguuggaccacggcuaauucaaagucacaaauaaauaggcaagucauaguugacagugaaaacuggucuggguauucugguaucuucucuguugaaggcaaaaacugcaucaacaggugcuuuuauguggagcugauaagagggaggccacaggagcccagagugugguggacuucaaauagcaucauuguauucuguggaaccucagguacauaugggacaggcucauggccugauggagcgaauaucaacuucaugccuauauaa

SEQ ID NO: 54232 - RNA, 1356 nt, Artificial Sequence; identical to SEQ ID NO: 54149
  neuraminidase__InfluenzaA__AGR33912

SEQ ID NO: 54233 - RNA, 1356 nt, Artificial Sequence; identical to SEQ ID NO: 54177
  neuraminidase__InfluenzaA__AGR33913

SEQ ID NO: 54234 - RNA, 1356 nt, Artificial Sequence
  neuraminidase__InfluenzaA__AGR33915
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugccacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54235 - RNA, 1356 nt, Artificial Sequence
  neuraminidase__InfluenzaA__AGR33916
augaauccaaaucagaaacuauucgcaucauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuauguaauguugaagggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucucuacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguagucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagccccagaucaagaaguggguuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54236 - RNA, 1356 nt, Artificial Sequence
  neuraminidase__InfluenzaA__AGR33917
augaauccaaaucagaaacuauucgcauuauccggaguggcaauagcgcuuaguguacugaacuuauugauaggacucucaaaugucggauugaauguaucucuacaucuaaaagaaacaggacccaaacaggaagagaauuugacaugcaugacuaccaaagaaacugaauugggaacaccaagcuaucugcuguugaacaagagucuaugcaauguugaggggugggucgugauagcaaaagacaaugcaguaagauuuggggaaagugagcaaaucauuauuaccagagaaccauacguaucaugugacccaaauggaugcaaaauguaugccuugcaucaagggacuaccauuaggaacaaacauucaaacggaacaauucacgacagaacagccuucagaggucucaucuccacuccauugggcacuccaccaaccguaaguaauagugauuuuauauguguuggauggucaagcacaacuugccaugauggaauuggcagaaugacuaucuguauacaagggaauaaugacaaugcuacagcaacgguuuauuauaacagaaggcugaccacuaccauuaagaccugggcuagaaacauucugaggacucaagagucagaaugugugugccacaacggcacaugugcaguuguaaugaccgaugggucggcuaguggucaagcccauacaaaaguaauguauuuccacaagggguugguaguuaaggaggaggcauugaagggaucggccaaacauauugaggagugcuccuguuacgggcacaaucaaaaggugaccugugugugcagagauaauuggcagggagcaaacagaccuauuauagaaauugacaugaacacauuggaacacacaaguagauaugugugcaccggaauucucaccgauacuagcagacccggggacaaaccuacuggugauuguuccaauccaauaacuggaaguccuggcgcuccgggagugaagggauuuggauuucuaaauggggauaauacauggcuugguaggaccaucagucccagaucaagaaguggauuugaaaugcugaaaauaccuaacgcagguauugaucccaauucuagaauagcugagcggcaggaaauugucgacaacagcaauuggucaggcuauuccggaagcuuuauugacuauuggaaugauaacagugaguguuacaauccauguuucuacguagaguuaauuagagggagacccgaagaggcuaaauaugugugguggacaaguaacagucuaauugcccuauguggaagcccauucccaguuggguccgguuccuuccccgauggggcacagauccaauacuuuucguaa

SEQ ID NO: 54237 - RNA, 1356 nt, Artificial Sequence; identical to SEQ ID NO: 54147
  neuraminidase__InfluenzaA__AGR33918

SEQ ID NO: 54238 - RNA, 1398 nt, Artificial Sequence; identical to SEQ ID NO: 54226
  neuraminidase__InfluenzaA__AGR33919

SEQ ID NO: 54239 - RNA, 1413 nt, Artificial Sequence
  neuraminidase__InfluenzaA__AGR45094
augaauccaaaucagaaaauaauaaccauuggaucaaucaguauggcaaucggaauaauuagucuaauauugcaaauaggaaauauuauuucaauaugggcuagccacucaauucaaacuggaagucaaaaccacacuggaauaugcaaccaaagaaucauuacauaugaaaauagcaccugggugaaucaaacauauguuaauauuaacaacacuaauguuguugcuggaaaggacaaaacuucagugacauuggccggcaauucaucucuuugcccuauccgugggugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucgguugcuuggucagcaagcgcaugccaugauggcaugggcuggcuaacaaucggaauuucugguccagauaauggagcaguggcuguacuaaaauacaacggcauaauaacugaaaccauaaaaaguuggaagaagcgaauauuaagaacacaagagucugaaugugucugugugaacgguucauguuuuaccauaaugaccgauggcccgaguaaugggccggccucguacagaaucuucaaaaucgagaaggggaagauuacuaaaucaauagaguuggaugcacccaauuaucauuacgaggaauguuccuguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagcuccagaaagggauuugagaugauuugggauccuaauggauggacagauaccgacagugauuucucugugaaacaggaugucgugccaaugacugauuggucaggguacagcggaaguuucguucaacauccugagcuaacaggauuggacuguaugagaccuugcuucuggguugaauuaaucagagggcgaccuagagaaaauacaacaaucuggacuagugggagcagcauuucuuuuuguggcguaaauagcgauacugcaaacuggucuuggccagacgaugccgaguugccauugaccauugacaaguag

SEQ ID NO: 54240 - RNA, 1413 nt, Artificial Sequence
  neuraminidase__InfluenzaA__AGR49780
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcaguauuucuuuuuguggcguuaauagugauacugcaaacuggucuuggccagacggugcugaguugccguucaccauugacaaguag

SEQ ID NO: 54241 - RNA, 1410 nt, Artificial Sequence
  neuraminidase__InfluenzaA__AGR49804
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuaacgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54242 - RNA, 1413 nt, Artificial Sequence; identical to SEQ ID NO: 50745
  neuraminidase__InfluenzaA__AGR49820

SEQ ID NO: 54243 - RNA, 1410 nt, Artificial Sequence
  neuraminidase__InfluenzaA__AGR49832
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccacaauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguucgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacagugguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 54244 - RNA, 1413 nt, Artificial Sequence; identical to SEQ ID NO: 50442
  neuraminidase__InfluenzaA__AGR49844

SEQ ID NO: 54245 - RNA, 1413 nt, Artificial Sequence; identical to SEQ ID NO: 50745
  neuraminidase__InfluenzaA__AGR49856

SEQ ID NO: 54246 - RNA, 1413 nt, Artificial Sequence
  neuraminidase__InfluenzaA__AGR49868
augaacccaaaucaaaagauaauaaccauuggaucaaucaguauagcaauuggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccugcuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaggauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 54247 - RNA, 1410 nt, Artificial Sequence; identical to SEQ ID NO: 47241
  neuraminidase__InfluenzaA__AGR49880

SEQ ID NO: 54248 - RNA, 1410 nt, Artificial Sequence; identical to SEQ ID NO: 49746
  neuraminidase__InfluenzaA__AGR49891

SEQ ID NO: 54249 - RNA, 1410 nt, Artificial Sequence
  neuraminidase__InfluenzaA__AGR49903
augaauccaaaucagaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguucccuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaggaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucacagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggagcggacaucaaucucaugccuauauaa

SEQ ID NO: 54250 - RNA, 1410 nt, Artificial Sequence
  neuraminidase__InfluenzaA__AGR49915
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguucgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 54251 - RNA, 1410 nt, Artificial Sequence
  neuraminidase__InfluenzaA__AGR49927
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguucgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguagaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 54252 - RNA, 1410 nt, Artificial Sequence
  neuraminidase__InfluenzaA__AGR49939
augaauccaaauaaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 54253 - RNA, 1410 nt, Artificial Sequence
  neuraminidase__InfluenzaA__AGR49951
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucugcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcugaaaucaaucucaugccuauauaa

SEQ ID NO: 54254 - RNA, 1410 nt, Artificial Sequence
  neuraminidase__InfluenzaA__AGR49963
augaauccaaauaaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcaagaagucacgcuuaggguaugaaaccuuuaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaagucuuguggaccucaaacaguauuguuguguuuuguggcaccucagguacauauggaacaggcucauggccugauggggcggacaucaaucucaugccuauauaa

SEQ ID NO: 54255 - RNA, 1410 nt, Artificial Sequence
  neuraminidase__InfluenzaA__AGR49975
augaauccaaaccaaaagauaauaaccauugguucggucuguaugacaauuggaauggcuaacuuaauauuacaaauuggaaacauaaucucaauauggauuagucacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54256 - RNA, 1413 nt, Artificial Sequence
  neuraminidase__InfluenzaA__AGR49986
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 54257 - RNA, 1413 nt, Artificial Sequence; identical to SEQ ID NO: 54256
  neuraminidase__InfluenzaA__AGR49998

SEQ ID NO: 54258 - RNA, 1410 nt, Artificial Sequence; identical to SEQ ID NO: 47241
  neuraminidase__InfluenzaA__AGR50010

SEQ ID NO: 54259 - RNA, 1410 nt, Artificial Sequence; identical to SEQ ID NO: 47241
  neuraminidase__InfluenzaA__AGR50021

SEQ ID NO: 54260 - RNA, 1410 nt, Artificial Sequence; identical to SEQ ID NO: 47242
  neuraminidase__InfluenzaA__AGR50032

SEQ ID NO: 54261 - RNA, 1410 nt, Artificial Sequence
  neuraminidase__InfluenzaA__AGR50043
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacacugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucaggcacauauggaacaggcucauggccugauggggcggaccucaaucucaugccuauauaa

SEQ ID NO: 54262 - RNA, 1410 nt, Artificial Sequence
  neuraminidase__InfluenzaA__AGR50055
augaauccaaaccaaaagauaauaaccauugguucggucuguaugacgauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54263 - RNA, 1410 nt, Artificial Sequence
  neuraminidase__InfluenzaA__AGR50066
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcugacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54264 - RNA, 1410 nt, Artificial Sequence; identical to SEQ ID NO: 47241
  neuraminidase__InfluenzaA__AGR50077

SEQ ID NO: 54265 - RNA, 1410 nt, Artificial Sequence; identical to SEQ ID NO: 47275
  neuraminidase__InfluenzaA__AGR50088

SEQ ID NO: 54266 - RNA, 1410 nt, Artificial Sequence; identical to SEQ ID NO: 47241
  neuraminidase__InfluenzaA__AGR50099

SEQ ID NO: 54267 - RNA, 1410 nt, Artificial Sequence; identical to SEQ ID NO: 47275
  neuraminidase__InfluenzaA__AGR50110

SEQ ID NO: 54268 - RNA, 1410 nt, Artificial Sequence
  neuraminidase__InfluenzaA__AGR50121
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaccgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54269 - RNA, 1410 nt, Artificial Sequence
  neuraminidase__InfluenzaA__AGR50132
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcaugugcaaaugguucuugcuuuacuguaaugaccgauggaccaaguaauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuucguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54270 - RNA, 1410 nt, Artificial Sequence
  neuraminidase__InfluenzaA__AGR50143
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagagauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54271 - RNA, 1410 nt, Artificial Sequence
  neuraminidase__InfluenzaA__AGR50154
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54272 - RNA, 1413 nt, Artificial Sequence; identical to SEQ ID NO: 54256
  neuraminidase__InfluenzaA__AGR50165

SEQ ID NO: 54273 - RNA, 1410 nt, Artificial Sequence; identical to SEQ ID NO: 47241
  neuraminidase__InfluenzaA__AGR50177

SEQ ID NO: 54274 - RNA, 1410 nt, Artificial Sequence; identical to SEQ ID NO: 47241
  neuraminidase__InfluenzaA__AGR50188

SEQ ID NO: 54275 - RNA, 1410 nt, Artificial Sequence
  neuraminidase__InfluenzaA__AGR50199
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggagugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54276 - RNA, 1410 nt, Artificial Sequence; identical to SEQ ID NO: 47241
  neuraminidase__InfluenzaA__AGR50210

SEQ ID NO: 54277 - RNA, 1410 nt, Artificial Sequence
  neuraminidase__InfluenzaA__AGR50221
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucaaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauaggaagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54278 - RNA, 1410 nt, Artificial Sequence
  neuraminidase__InfluenzaA__AGR50232
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaauaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguagguuggucuuggccagacggugcugaguugccauuuaccauugacaaguaa

SEQ ID NO: 54279 - RNA, 1410 nt, Artificial Sequence
  neuraminidase__InfluenzaA__AGR50243
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggaguagcauauccuuuugugguguaaacagugacacuguggguuggucuuggccagacggugcugaguugccauuuaccauugacaaguaa

SEQ ID NO: 54280 - RNA, 1410 nt, Artificial Sequence; identical to SEQ ID NO: 47241
  neuraminidase__InfluenzaA__AGR50254

SEQ ID NO: 54281 - RNA, 1410 nt, Artificial Sequence; identical to SEQ ID NO: 47241
  neuraminidase__InfluenzaA__AGR50265

SEQ ID NO: 54282 - RNA, 1410 nt, Artificial Sequence
  neuraminidase__InfluenzaA__AGR50276
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagagauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54283 - RNA, 1410 nt, Artificial Sequence; identical to SEQ ID NO: 47241
  neuraminidase__InfluenzaA__AGR50287

SEQ ID NO: 54284 - RNA, 1410 nt, Artificial Sequence
  neuraminidase__InfluenzaA__AGR50298
augaauccaaaccaaaagauaauaaccauugguucggucuguaugacaauuggaauggcuaacuuaauauuacaaauuggaaacacaaucucaauauggauuagccacucaauucaaccugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcaucuccuuuugugguguaaacagugacacuguggguuggucuuggccagacggugcugaguugccauuuaccauugacaaguaa

SEQ ID NO: 54285 - RNA, 1410 nt, Artificial Sequence
  neuraminidase__InfluenzaA__AGR50309
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54286 - RNA, 1410 nt, Artificial Sequence; identical to SEQ ID NO: 47241
  neuraminidase__InfluenzaA__AGR50320

SEQ ID NO: 54287 - RNA, 1410 nt, Artificial Sequence; identical to SEQ ID NO: 47275
  neuraminidase__InfluenzaA__AGR50331

SEQ ID NO: 54288 - RNA, 1410 nt, Artificial Sequence
  neuraminidase__InfluenzaA__AGR50342
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugauuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54289 - RNA, 1410 nt, Artificial Sequence; identical to SEQ ID NO: 47241
  neuraminidase__InfluenzaA__AGR50353

SEQ ID NO: 54290 - RNA, 1413 nt, Artificial Sequence
  neuraminidase__InfluenzaA__AGR50364
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccauccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcaguauuucuuuuuguggcguuaauagugauacugcaaacuggucuuggccagacggugcugaguugccguucaccauugacaaguag

SEQ ID NO: 54291 - RNA, 1410 nt, Artificial Sequence
  neuraminidase__InfluenzaA__AGR55170
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaauguguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggauaugaaaccuucaaagucauugaaggcugguccaacccuaauuccaaauugcagauaaauaggcaaaucauaguugacagagguaauagguccgguuauucugguauuuucucuguugaaggcaaaagcugcaucaaucgguguuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 54292 - RNA, 1410 nt, Artificial Sequence
  neuraminidase__InfluenzaA__AGR55180
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcacaucagguacauauggaacaggcucauggccugauggggcggauaucaaucucaugccuauauaa

SEQ ID NO: 54293 - RNA, 1410 nt, Artificial Sequence
  neuraminidase__InfluenzaA__AGR55181
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugugauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguccauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaagguaaaagcugcaucaaucggugcuuuuauguggaguugauaaggggacggaaagaggaaacugaagucugguggaccucaaacaguauuguuguguuuuguggcaccucggguacauauggaacaggcucauggccugauggggcggauaucaaucucaugccuauauaa

SEQ ID NO: 54294 - RNA, 1410 nt, Artificial Sequence
  neuraminidase__InfluenzaA__AGR55183
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuagggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 54295 - RNA, 1410 nt, Artificial Sequence
  neuraminidase__InfluenzaA__AGR55184
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaaaaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucagggcuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 54296 - RNA, 1410 nt, Artificial Sequence
  neuraminidase__InfluenzaA__AGR55185
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaaaaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucagggcuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucacguacauauggaacaggcucauggccugauggggcggacaucaaucucaugccuauauaa

SEQ ID NO: 54297 - RNA, 1410 nt, Artificial Sequence
  neuraminidase__InfluenzaA__AGR55186
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauauuauucauugaggaggggaaaauuguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggaaccuaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 54298 - RNA, 1410 nt, Artificial Sequence
  neuraminidase__InfluenzaA__AGR55187
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuagggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguccauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaagguaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 54299 - RNA, 1410 nt, Artificial Sequence; identical to SEQ ID NO: 52734
  neuraminidase__InfluenzaA__AGR55192

SEQ ID NO: 54300 - RNA, 1410 nt, Artificial Sequence
  neuraminidase__InfluenzaA__AGR55195
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaauggaaggcuuguagauaguauuguuucaugguccaaagaaauccucaggacccaggagucagaaugcguuuguaucaauggaacuuguacaguaguaaugacugaugggagugcuucaggaaaagccgauacuaaaauacuauucauugaggaggggaaaaucguucauacuagcacauugucaggaagugcucagcaugucgaggagugcuccugcuauccucgauauccuggugucagaugugucugcagagaccacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggaugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 54301 - RNA, 1410 nt, Artificial Sequence
  neuraminidase__InfluenzaA__AGR55204
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuauccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcauguagaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucacguacauauggaacaggcucauggccugauggggcggacaucaaucucaugccuauauaa

SEQ ID NO: 54302 - RNA, 1410 nt, Artificial Sequence
  neuraminidase__InfluenzaA__AGR55218
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaguggugcugugugaaccaacaauaauagaaagaaacauaacagagauaguguaucugaccaacaccaccauagagaaggaaauaugcccuaaacuagcagaauacagaaauuggucaaagccgcaaugugacaucacaggauuugcaccuuuuucuaaggacaauucgauuaggcuuuccgcugguggggacaucugggugacaagagaaccuuaugugucaugcgauccugacaaguguuaucaauuugcccucggacagggaacaacacuaaacaacgugcauucaaauaacacaguacgugauaggaccccuuaccggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 54303 - RNA, 1410 nt, Artificial Sequence
  neuraminidase__InfluenzaA__AGT18726
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuuuggagacaauccacguccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54304 - RNA, 1410 nt, Artificial Sequence
  neuraminidase__InfluenzaA__AGT18727
augaauccaaaccaaaagauaauaaccauugguucggucuguaugacaauuggaauggcuaacuuaauauuacaaauuggaaacauaaucucaauauggauuagccacucaauucaacuugggagucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaaugggguaaaaggauuuucauucaaauacggcaaugguguuuggauagggagaacuaaaagcauuaguucaagaaaagguuuugagaugauuugggauccaaauggauggucugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54305 - RNA, 1410 nt, Artificial Sequence
  neuraminidase__InfluenzaA__AGT18728
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54306 - RNA, 1410 nt, Artificial Sequence
  neuraminidase__InfluenzaA__AGT18729
augaauccaaaccaaaagauaauaaccauuggacaggucuguaugacaauuggaauggcuaacuuaauauuacaaauuggaaacauaaucucaauauggauuagccacucaauucaacuugggagucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54307 - RNA, 1410 nt, Artificial Sequence
  neuraminidase__InfluenzaA__AGT18730
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggagugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugacugauggaccaagugauggacaggccucauacaagaucuucagaauagaaaagggaaagauagucaaaucagucgaaauuaaugccccuaauuaucacuaugaggaaugcuccuguuauccugauucuagugaaaucacaugugugugcagggauaacuggcauggcucgaaucgaccgugggugucuuucaaccagaaucuggaauaccagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54308 - RNA, 1410 nt, Artificial Sequence
  neuraminidase__InfluenzaA__AGT18731
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuucugugguguaaacagugacacuguggguuggucuuggccagacggugcugaguugccauuuaccauugacaaguaa

SEQ ID NO: 54309 - RNA, 1410 nt, Artificial Sequence
  neuraminidase__InfluenzaA__AGT18732
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagaggaagcagcauauccuuuugugguguaaacagugacacuguggguuggucuuggccagacggugcugaguugccauuuaccauugacaaguaa

SEQ ID NO: 54310 - RNA, 1410 nt, Artificial Sequence
  neuraminidase__InfluenzaA__AGT18733
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaagcacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcggaagcagcagauccuuuugugguguaaacagugacacuguggguuggucuuggccagacggugcugaguugccauuuaccauugacaaguaa

SEQ ID NO: 54311 - RNA, 1410 nt, Artificial Sequence
  neuraminidase__InfluenzaA__AGT18762
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugacacugugugaaccaauaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguucccuuucaucuggggaccaagcaagugugcauagcaugguccagcucaaguugucacgauggaaaagcauggcugcauguuuguauaacgggagaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucuaaugccuauauaa

SEQ ID NO: 54312 - RNA, 1410 nt, Artificial Sequence
  neuraminidase__InfluenzaA__AGT18764
augaacccaaaucaaaugauaauaacgauuggcucuguuucucucaccaguuccacaauaugcuucuucaugcaaacugccagcuucauaacuacuguaacauugcauaucaagcaacaugaauuccacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccacaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccugguguuagaugugucugcagagacaacuggaaaggcuccaauaggcccaucguugauauaaacaugaaggaucauagcauuguuuccaguuauguguguucaggacuuguuggagacacacccagaaaaaacgacagauccagcaauagccauuguuuggauccuaacaaugaagaagguggucauggagugaaaggcugggccuuugaugauggaaaugacguguggaugggaagaacgaucaacgagacgucgcgccuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuugcggcaccucagguacauauggaacaggcucauggccugauggggcggaccucaaucucaugccuauauaa

SEQ ID NO: 54313 - RNA, 1410 nt, Artificial Sequence
  neuraminidase__InfluenzaA__AGT18765
augaauccaaaucaaaagauaauaacgauuggcucuguuucucucaccauuuccacaauaugcuucuucaugcaaauugccaucuugauaacuacuguaacauugcauuucaagcaacaugaauuccacucccccccaaacaaccaagugaugcugugugaaccaacaauaauagaaagaaacauaacagagauaguguauuugaccaacaccaccauagagaaggaaauaugccccaaacuagcagaauacagaaauuggucgaagccacaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacgguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacaugaaggaucauagcauuguuuccaguuauguguguucaggacuuguuggagacacacccagaaaaaacgacagauccagcaauagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54314 - RNA, 1410 nt, Artificial Sequence
  neuraminidase__InfluenzaA__AGT18766
augaauccaaaucaaaagauaauaacgauuggcucuguuucucucaccauuuccacaauaugcuuauucaugcaaauugccaucuugauaacuacuguaacauugcauuucaagcaacaugaauuccacucccccccaaacaaccaagugaugcugugugaaccaacaauaauagaaagaaacauaacagagauaguguaucugaccaacaccaccauagagaaggaaauaugccccaaacuagcagaauacagaaauuggucgaagccacaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacgguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacaugaaggaucauagcauuguuuccaguuauguguguucaggacuuguuggagacacacccagaaaaaacgacagauccagcaauagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaagccuauauaa

SEQ ID NO: 54315 - RNA, 1410 nt, Artificial Sequence
  neuraminidase__InfluenzaA__AGT18767
augaacccaaaucaaaagauaauaacgauuggcucuguuucucucaccauuuccacaauaugcuucuucaugcaaacugccagcuugauaacuacuguaacauugcauuucaagcaacaugaauuccacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccacaaugugacauuacaggauuugcaccuuuuucuaaggacaauucgauuaggcuuuccgcugguggggacaucuggguaacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuggguguuccuuuucaucuggggaccaagcaagugugcauagcaugguccagcucaaguugucacgauggcaaagcauggcugcauguuuguauaacgggggaugacaaaaaugcaacugcuagcuucauuuacaaugggaggcuuguagacaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacaugaaggaucauagcauuguuuccaguuauguguguucaggacuuguuggagacacacccagaaaaaacgacagauccagcaauagccauuguuuggauccuaacaaugaagaagguggucauggagugaaaggcugggccuuugaugauggaaaugacguguggaugggaagaacgaucaaugagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggagcggaucucaaucucaugccuauauaa

SEQ ID NO: 54316 - RNA, 1410 nt, Artificial Sequence
  neuraminidase__InfluenzaA__AGT18768
augaacccaaaucaaaagauaauaacgauuggcucuguuucucuuaccauuuccacaauaugcuucuucaugcaaacugccagcuucauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccacaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccccgauauccuggugucagaugugucugcagagacaacuggaaaggcuccaauaggcccaucguugauauaaacaugaaggaucauagcauuguuuccaguuauguguguucaggacuuguuggagacacacccagaaaaaacgacagauccagcaauagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54317 - RNA, 1410 nt, Artificial Sequence
  neuraminidase__InfluenzaA__AGT18769
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucagaacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucuaaugccuauauaa

SEQ ID NO: 54318 - RNA, 1410 nt, Artificial Sequence
  neuraminidase__InfluenzaA__AGT18770
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaacaaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucagaacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucuaaugccuauauaa

SEQ ID NO: 54319 - RNA, 1410 nt, Artificial Sequence
  neuraminidase__InfluenzaA__AGT18771
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucuaaugccuauauaa

SEQ ID NO: 54320 - RNA, 1410 nt, Artificial Sequence
  neuraminidase__InfluenzaA__AGT18772
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguucccuuucaucuggggaccaagcaagugugcauagcaugguccagcucaaguugucacgauggaaaagcauggcugcauguuuguauaacgggagaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucuaaugccuauauaa

SEQ ID NO: 54321 - RNA, 1410 nt, Artificial Sequence
  neuraminidase__InfluenzaA__AGT37104
augaauccaaaucaaaagauaauaacaauugguucaguuucccucaccauugccacaauaugccuccuuaugcaaauugccauucugguaacuacuguaacauuacauuucaagcaauaugaaugcaguuccccuccaaacaaccaaguaaugccgugugaaccaacaauaauagagagaaacauaacaaagauaguguaucugaccaacaccacuauagagagagaggcaugccccgaacuagcagaauacagacacuggucaaagccgcaauguaaaauuagaggauuugcaccuuuuucuaaggacaauucaauucgacuuucugcugguggagacauuugggugacaagagaaccuuaugugucaugugauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucaugauggaaaagcaugguugcauguuuguauaacagggcaugauaaaaaugcaacugcuagcuucauuuacgaugggaggcuuguagacaguaucgguucauggucacaaaacauccucagaacccaggagucugaaugcguuuguaucaauggaacuuguacaguaguaaugacugauggaagugcuucaggaagagcugauaccaaaauaauguuuguugaagaggggaaaaucguucauauuagcccauuggcaggaagugcccagcacguugaggagugcuccuguuauccuaaauauccuggugucagaugugucugcagagacaacuggaaagguuccaauaggcccauuguagauauaaauaugaaagauuauagcauuguuuccaguuaugugugcucaggacuugugggagacacacccaggagaaacgauaguucuagcaccagcuauugcuugaauccuaacaaugaggaaggggggcauggagugaaaggcugggccuuugaugauggagaugauguguggaugggaagaacaauaagcgagaaguuacguuuagguuacgaaacuuucaaagucauuggagguugguccaaaccuaauucaaaauugcaaauaaauaggcaagucguaguugacauaaguaauagauccgguuauucugguauuuucucuguugaaggcaaaagcugcaucaaucggugcuuuuauguggaguugauaaggggaaggaagcaggaaaaugaagucugguggacaucaaauaguauuguuguguuuugugguaccucagguacauauggaacaggcucauggccugacggggcggacaucaaucucaugccuauauaa

SEQ ID NO: 54322 - RNA, 1410 nt, Artificial Sequence
  neuraminidase__InfluenzaA__AGU69973
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuacgugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugcgcucaggacuuguuggagacacacccagaaaaaacgauagcuccagcaguagccauugcuuggauccuaacaaugaggaagguggucauggagugaaaggcugggccuuugaugauggaaacgacguguggaugggaagaacgaucagcgagaagucacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggagggaaacaggaaacugaagucuuguggaccucaaacaguauuguuguguuuuguggcaccucagguacauauggaacaggcucauggccugauggggcggaccucaaucucaugccuauauaa

SEQ ID NO: 54323 - RNA, 1410 nt, Artificial Sequence
  neuraminidase__InfluenzaA__AGU92648
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucauaugugugugcagggauaacuggcauggcucgaaucgaccaugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacuggaacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 54324 - RNA, 1410 nt, Artificial Sequence
  neuraminidase__InfluenzaA__AGU92670
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucauaugugugugcagggauaacuggcauggcucgaaucgaccaugggugucuuucaaccagaaucuggaauaucagauaggauacauaugcagugggauuuucggagacaauccacgcccugaugauaaaacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacuggaacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 54325 - RNA, 1410 nt, Artificial Sequence
  neuraminidase__InfluenzaA__AGU92681
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuacauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucauaugugugugcagggauaacuggcauggcucgaaucgaccaugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacuggaacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 54326 - RNA, 1410 nt, Artificial Sequence
  neuraminidase__InfluenzaA__AGU92692
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagagucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggcuacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuauucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54327 - RNA, 1410 nt, Artificial Sequence; identical to SEQ ID NO: 54326
  neuraminidase__InfluenzaA__AGU92703

SEQ ID NO: 54328 - RNA, 1410 nt, Artificial Sequence; identical to SEQ ID NO: 54326
  neuraminidase__InfluenzaA__AGU92714

SEQ ID NO: 54329 - RNA, 1410 nt, Artificial Sequence; identical to SEQ ID NO: 54326
  neuraminidase__InfluenzaA__AGU92725

SEQ ID NO: 54330 - RNA, 1410 nt, Artificial Sequence; identical to SEQ ID NO: 54326
  neuraminidase__InfluenzaA__AGU92736

SEQ ID NO: 54331 - RNA, 1410 nt, Artificial Sequence; identical to SEQ ID NO: 54326
  neuraminidase__InfluenzaA__AGU92747

SEQ ID NO: 54332 - RNA, 1410 nt, Artificial Sequence; identical to SEQ ID NO: 54326
  neuraminidase__InfluenzaA__AGU92758

SEQ ID NO: 54333 - RNA, 1410 nt, Artificial Sequence; identical to SEQ ID NO: 54323
  neuraminidase__InfluenzaA__AGU92769

SEQ ID NO: 54334 - RNA, 1410 nt, Artificial Sequence; identical to SEQ ID NO: 54323
  neuraminidase__InfluenzaA__AGU92780

SEQ ID NO: 54335 - RNA, 1410 nt, Artificial Sequence
  neuraminidase__InfluenzaA__AGU92791
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaucuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucauaugugugugcagggauaacuggcauggcucgaaucgaccaugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacuggaacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 54336 - RNA, 1410 nt, Artificial Sequence; identical to SEQ ID NO: 54323
  neuraminidase__InfluenzaA__AGU92802

SEQ ID NO: 54337 - RNA, 1410 nt, Artificial Sequence; identical to SEQ ID NO: 54323
  neuraminidase__InfluenzaA__AGU92813

SEQ ID NO: 54338 - RNA, 1410 nt, Artificial Sequence; identical to SEQ ID NO: 54323
  neuraminidase__InfluenzaA__AGU92824

SEQ ID NO: 54339 - RNA, 1410 nt, Artificial Sequence
  neuraminidase__InfluenzaA__AGU92846
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagagucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggcuacauaugcagugggauuuucggagacaauccacgcccuaaugauaagacaggcaguugugguccaguaucgucuaauggagcaaauggaguaaaaggauuugcauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuauucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54340 - RNA, 1410 nt, Artificial Sequence
  neuraminidase__InfluenzaA__AGU92868
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuugcgggcaauuccucucucugcccuguuaguggaugggcuauauacaguaaagacaacaguguaagagucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggcuacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuauucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54341 - RNA, 1410 nt, Artificial Sequence
  neuraminidase__InfluenzaA__AGU92890
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagagucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggcuacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuauucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54342 - RNA, 1410 nt, Artificial Sequence; identical to SEQ ID NO: 54323
  neuraminidase__InfluenzaA__AGU92901

SEQ ID NO: 54343 - RNA, 1410 nt, Artificial Sequence; identical to SEQ ID NO: 54323
  neuraminidase__InfluenzaA__AGU92912

SEQ ID NO: 54344 - RNA, 1410 nt, Artificial Sequence; identical to SEQ ID NO: 54323
  neuraminidase__InfluenzaA__AGU92923

SEQ ID NO: 54345 - RNA, 1410 nt, Artificial Sequence; identical to SEQ ID NO: 54326
  neuraminidase__InfluenzaA__AGU92934

SEQ ID NO: 54346 - RNA, 1410 nt, Artificial Sequence; identical to SEQ ID NO: 54326
  neuraminidase__InfluenzaA__AGU92945

SEQ ID NO: 54347 - RNA, 1410 nt, Artificial Sequence; identical to SEQ ID NO: 54326
  neuraminidase__InfluenzaA__AGU92956

SEQ ID NO: 54348 - RNA, 1410 nt, Artificial Sequence; identical to SEQ ID NO: 54323
  neuraminidase__InfluenzaA__AGU92967

SEQ ID NO: 54349 - RNA, 1410 nt, Artificial Sequence; identical to SEQ ID NO: 54323
  neuraminidase__InfluenzaA__AGU92978

SEQ ID NO: 54350 - RNA, 1410 nt, Artificial Sequence
  neuraminidase__InfluenzaA__AGU92989
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagagucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggcuacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54351 - RNA, 1410 nt, Artificial Sequence; identical to SEQ ID NO: 54340
  neuraminidase__InfluenzaA__AGU93000

SEQ ID NO: 54352 - RNA, 1410 nt, Artificial Sequence; identical to SEQ ID NO: 54341
  neuraminidase__InfluenzaA__AGU93011

SEQ ID NO: 54353 - RNA, 1365 nt, Artificial Sequence; identical to SEQ ID NO: 50894
  neuraminidase__InfluenzaA__AGU93022

SEQ ID NO: 54354 - RNA, 1410 nt, Artificial Sequence
  neuraminidase__InfluenzaA__AGU93034
augaauccaacccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacaccuggguaaaucagacauauguuaacaucagcaacaccaacuuugcugcuggacaaucaguugcuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaauaacaugugugugcagggauaacuggcauggcucgaaucgaccgugggugucuuucaaccagaaucuggaauaucagauaggauacauaugcaguggaauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacugacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54355 - RNA, 1410 nt, Artificial Sequence
  neuraminidase__InfluenzaA__AGU93045
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggcauugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggagcuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 54356 - RNA, 1410 nt, Artificial Sequence; identical to SEQ ID NO: 54323
  neuraminidase__InfluenzaA__AGU93056

SEQ ID NO: 54357 - RNA, 1410 nt, Artificial Sequence
  neuraminidase__InfluenzaA__AGV98980
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54358 - RNA, 1410 nt, Artificial Sequence
  neuraminidase__InfluenzaA__AGV98993
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54359 - RNA, 1410 nt, Artificial Sequence; identical to SEQ ID NO: 54358
  neuraminidase__InfluenzaA__AGV99005

SEQ ID NO: 54360 - RNA, 1410 nt, Artificial Sequence; identical to SEQ ID NO: 54358
  neuraminidase__InfluenzaA__AGV99017

SEQ ID NO: 54361 - RNA, 1410 nt, Artificial Sequence
  neuraminidase__InfluenzaA__AGV99040
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54362 - RNA, 1410 nt, Artificial Sequence
  neuraminidase__InfluenzaA__AGV99052
augaauccaaaucaaaagauaauaacgauuggcucuguuucucucaccauuuccacaauaugcuucuucaugcaaauugccaucuugauaacuacuguaacauugcauuucaagcaauaugaauucaacuccccuccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacccuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauaccaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcguuauuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggaugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54363 - RNA, 1410 nt, Artificial Sequence
  neuraminidase__InfluenzaA__AGV99100
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaggaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcgucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 54364 - RNA, 1410 nt, Artificial Sequence; identical to SEQ ID NO: 54357
  neuraminidase__InfluenzaA__AGV99112

SEQ ID NO: 54365 - RNA, 1410 nt, Artificial Sequence; identical to SEQ ID NO: 54357
  neuraminidase__InfluenzaA__AGV99124

SEQ ID NO: 54366 - RNA, 1410 nt, Artificial Sequence; identical to SEQ ID NO: 54357
  neuraminidase__InfluenzaA__AGV99136

SEQ ID NO: 54367 - RNA, 1410 nt, Artificial Sequence; identical to SEQ ID NO: 54358
  neuraminidase__InfluenzaA__AGV99148

SEQ ID NO: 54368 - RNA, 1410 nt, Artificial Sequence; identical to SEQ ID NO: 54358
  neuraminidase__InfluenzaA__AGV99160

SEQ ID NO: 54369 - RNA, 1410 nt, Artificial Sequence
  neuraminidase__InfluenzaA__AGV99172
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 54370 - RNA, 1410 nt, Artificial Sequence; identical to SEQ ID NO: 54358
  neuraminidase__InfluenzaA__AGV99196

SEQ ID NO: 54371 - RNA, 1410 nt, Artificial Sequence; identical to SEQ ID NO: 53829
  neuraminidase__InfluenzaA__AGV99208

SEQ ID NO: 54372 - RNA, 1410 nt, Artificial Sequence
  neuraminidase__InfluenzaA__AGV99959
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54373 - RNA, 1410 nt, Artificial Sequence
  neuraminidase__InfluenzaA__AGW00005
augaauccaaaucaaaagauaauaacgauuggcucuguuucucucaccauuuccacaguaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54374 - RNA, 1410 nt, Artificial Sequence; identical to SEQ ID NO: 53829
  neuraminidase__InfluenzaA__AGW00068

SEQ ID NO: 54375 - RNA, 1410 nt, Artificial Sequence
  neuraminidase__InfluenzaA__AGW00080
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 54376 - RNA, 1410 nt, Artificial Sequence
  neuraminidase__InfluenzaA__AGW00104
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggagaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgccuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54377 - RNA, 1410 nt, Artificial Sequence; identical to SEQ ID NO: 54375
  neuraminidase__InfluenzaA__AGW00116

SEQ ID NO: 54378 - RNA, 1410 nt, Artificial Sequence; identical to SEQ ID NO: 54375
  neuraminidase__InfluenzaA__AGW00128

SEQ ID NO: 54379 - RNA, 1410 nt, Artificial Sequence; identical to SEQ ID NO: 54369
  neuraminidase__InfluenzaA__AGW00140

SEQ ID NO: 54380 - RNA, 1410 nt, Artificial Sequence
  neuraminidase__InfluenzaA__AGW00152
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaaguuauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaaguuuuguggaccucaaacaguauuguuguguuuuguggcaccucagguacauauggaacaggcucauggccugauggggcggaccucaaccucaugccuauauaa

SEQ ID NO: 54381 - RNA, 1410 nt, Artificial Sequence; identical to SEQ ID NO: 54375
  neuraminidase__InfluenzaA__AGW00164

SEQ ID NO: 54382 - RNA, 1410 nt, Artificial Sequence; identical to SEQ ID NO: 54357
  neuraminidase__InfluenzaA__AGW00176

SEQ ID NO: 54383 - RNA, 1410 nt, Artificial Sequence; identical to SEQ ID NO: 54358
  neuraminidase__InfluenzaA__AGW00188

SEQ ID NO: 54384 - RNA, 1410 nt, Artificial Sequence; identical to SEQ ID NO: 54357
  neuraminidase__InfluenzaA__AGW00712

SEQ ID NO: 54385 - RNA, 1410 nt, Artificial Sequence; identical to SEQ ID NO: 54357
  neuraminidase__InfluenzaA__AGW00724

SEQ ID NO: 54386 - RNA, 1410 nt, Artificial Sequence
  neuraminidase__InfluenzaA__AGW00736
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccgacccuaaguccaaauugcagauaaauaggcaagucauaguugacagaggugauagguccgguuauucugguauuuucucuguugaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 54387 - RNA, 1410 nt, Artificial Sequence
  neuraminidase__InfluenzaA__AGW00748
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54388 - RNA, 1410 nt, Artificial Sequence
  neuraminidase__InfluenzaA__AGW00760
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagguaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54389 - RNA, 1410 nt, Artificial Sequence
  neuraminidase__InfluenzaA__AGW00784
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaggaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54390 - RNA, 1410 nt, Artificial Sequence; identical to SEQ ID NO: 53829
  neuraminidase__InfluenzaA__AGW00796

SEQ ID NO: 54391 - RNA, 1410 nt, Artificial Sequence
  neuraminidase__InfluenzaA__AGW00808
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguugucucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaaguuuuguggaccucaaacaguauuguuguguuuuguggcaccucagguacauauggaacaggcucauggccugauggggcggaccucaaccucaugccuauauaa

SEQ ID NO: 54392 - RNA, 1410 nt, Artificial Sequence
  neuraminidase__InfluenzaA__AGW00820
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggguaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcucaagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54393 - RNA, 1410 nt, Artificial Sequence
  neuraminidase__InfluenzaA__AGW00832
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauagaaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54394 - RNA, 1410 nt, Artificial Sequence
  neuraminidase__InfluenzaA__AGW00844
augaauccaaaucaaaagauaauaacgauuggcucuguuucucucaccauuuccacaauaugcuucuucaugcaaauugccaucuugauaacuacuguaacauugcauuucaagcaauaugaauucaacuuccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaagagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54395 - RNA, 1410 nt, Artificial Sequence
  neuraminidase__InfluenzaA__AGW00868
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccccgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaaggacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54396 - RNA, 1410 nt, Artificial Sequence
  neuraminidase__InfluenzaA__AGW00880
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccucaaugugacauuacaggauuugcaccuuuuucuaaggacaauucgauuaggcuuuccgcugguggggacgucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccugaugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54397 - RNA, 1410 nt, Artificial Sequence
  neuraminidase__InfluenzaA__AGW00892
augaauccaaaucaaaagauaauaacgauuggcucuguuucucuaaccauuuccacaauaugcuucuucaugcaaauugccaucuugauaacuacuguaacauugcauuucaagcaauaugaauucaacccccccccaaacaaccaagugaugcugugugaaccaacgauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagaugaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54398 - RNA, 1410 nt, Artificial Sequence
  neuraminidase__InfluenzaA__AGW00904
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgguccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacaggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54399 - RNA, 1410 nt, Artificial Sequence
  neuraminidase__InfluenzaA__AGW00916
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguaugugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucaacaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54400 - RNA, 1410 nt, Artificial Sequence
  neuraminidase__InfluenzaA__AGW00934
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacucaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaaguuuuguggaccucaaacaguauuguuguguuuuguggcaccucagguacauauggaacaggcucauggccugauggggcggaccucaaccucaugccuauauaa

SEQ ID NO: 54401 - RNA, 1410 nt, Artificial Sequence
  neuraminidase__InfluenzaA__AGW01247
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaaagacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 54402 - RNA, 1410 nt, Artificial Sequence; identical to SEQ ID NO: 54372
  neuraminidase__InfluenzaA__AGW01259

SEQ ID NO: 54403 - RNA, 1410 nt, Artificial Sequence
  neuraminidase__InfluenzaA__AGW01298
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggagacuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54404 - RNA, 1410 nt, Artificial Sequence
  neuraminidase__InfluenzaA__AGW01322
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuaguuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagauguguaugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugacggggcggaccucaaucucaugccuauauaa

SEQ ID NO: 54405 - RNA, 1410 nt, Artificial Sequence
  neuraminidase__InfluenzaA__AGW01334
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaagcugaagucuuguggaccucaaacaguauuguuguguuuuguggcaccucagguacauauggaacaggcucauggccugauggggcggaccucaaucucaugccuauauaa

SEQ ID NO: 54406 - RNA, 1410 nt, Artificial Sequence
  neuraminidase__InfluenzaA__AGW01346
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucacggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54407 - RNA, 1410 nt, Artificial Sequence
  neuraminidase__InfluenzaA__AGW01358
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccaacagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54408 - RNA, 1410 nt, Artificial Sequence; identical to SEQ ID NO: 54372
  neuraminidase__InfluenzaA__AGW01370

SEQ ID NO: 54409 - RNA, 1410 nt, Artificial Sequence
  neuraminidase__InfluenzaA__AGW01382
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguccauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54410 - RNA, 1410 nt, Artificial Sequence
  neuraminidase__InfluenzaA__AGW01394
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagauauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 54411 - RNA, 1410 nt, Artificial Sequence
  neuraminidase__InfluenzaA__AGW01406
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacaugcauucaaauaacacaguacgugauaggaccccuuaucggacccuauugaugaaugaguuggguguuccuuuucaucuggggaccaagcaagugugcauagcaugguccagcucaagcugucacgauggaaaagcauggcugcauguuuguauaacgggggaugauaaaaaugcaacugcuagcuucauuuacaauggaaggcuuguagauaguguuguuucaugguccaaagaaauccucaggacccaggagucagaaugcguuugcaucaauggaacuuguacaguaguaauaacugaugggagugcuucgggaaaagcugauacuaaaauacuauucauugaggaggggaaaaucguucauacuagcacauugucaggaagugcucagcaugucgaggagugcucuugcuauccucgauacccuggugucagaugugucugcagagacaacuggaaaggcuccaauaggcccaucguagauauaaacauaaaggaucauagcauuguuuccaguuauguguguucagggcuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggcgauagguccgguuauucugguauuuucucuguugaaggcaaaagcugcaucaaucggugcuuuuauguggaguugaucaggggaagaaaagaggaaacugaagucuuguggaccucaaacaguauuguuguguuuuguggcaccucaggcacauauggaacaggcucauggccugauggggcggaccucaaucucaugccuauauaa

SEQ ID NO: 54412 - RNA, 1410 nt, Artificial Sequence
  neuraminidase__InfluenzaA__AGW01418
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaaccccaaguccaaauugcagauaaauaggcaagucauaguugacagaggugauagguccgguuauucugguauuuucucuguugaaggcaaaagcugcaucaaucggugcuuuuauguugaguugauuaggggaagaaaagaggaaacuggagucuuguggaccucaaacaguauuguuguguuuuguggcaccucagguacauauggaacaggcucauggccugauggggcggaccucaaucucaugccuauauaa

SEQ ID NO: 54413 - RNA, 1410 nt, Artificial Sequence
  neuraminidase__InfluenzaA__AGW01430
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54414 - RNA, 1410 nt, Artificial Sequence
  neuraminidase__InfluenzaA__AGW01442
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54415 - RNA, 1410 nt, Artificial Sequence; identical to SEQ ID NO: 54372
  neuraminidase__InfluenzaA__AGW01454

SEQ ID NO: 54416 - RNA, 1410 nt, Artificial Sequence; identical to SEQ ID NO: 54375
  neuraminidase__InfluenzaA__AGW01466

SEQ ID NO: 54417 - RNA, 1410 nt, Artificial Sequence; identical to SEQ ID NO: 54357
  neuraminidase__InfluenzaA__AGW01478

SEQ ID NO: 54418 - RNA, 1410 nt, Artificial Sequence
  neuraminidase__InfluenzaA__AGW01490
augaauccaaaucaaaagauaauaacgauuagcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuugcacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacucuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54419 - RNA, 1410 nt, Artificial Sequence
  neuraminidase__InfluenzaA__AGW01538
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggacccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 54420 - RNA, 1410 nt, Artificial Sequence; identical to SEQ ID NO: 54375
  neuraminidase__InfluenzaA__AGW01562

SEQ ID NO: 54421 - RNA, 1410 nt, Artificial Sequence; identical to SEQ ID NO: 54357
  neuraminidase__InfluenzaA__AGW01574

SEQ ID NO: 54422 - RNA, 1410 nt, Artificial Sequence; identical to SEQ ID NO: 54357
  neuraminidase__InfluenzaA__AGW01586

SEQ ID NO: 54423 - RNA, 1410 nt, Artificial Sequence; identical to SEQ ID NO: 54357
  neuraminidase__InfluenzaA__AGW01598

SEQ ID NO: 54424 - RNA, 1410 nt, Artificial Sequence; identical to SEQ ID NO: 54375
  neuraminidase__InfluenzaA__AGW01610

SEQ ID NO: 54425 - RNA, 1410 nt, Artificial Sequence
  neuraminidase__InfluenzaA__AGW01622
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccacaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54426 - RNA, 1410 nt, Artificial Sequence; identical to SEQ ID NO: 54406
  neuraminidase__InfluenzaA__AGW01634

SEQ ID NO: 54427 - RNA, 1410 nt, Artificial Sequence
  neuraminidase__InfluenzaA__AGW01646
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucgauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54428 - RNA, 1410 nt, Artificial Sequence; identical to SEQ ID NO: 54369
  neuraminidase__InfluenzaA__AGW01670

SEQ ID NO: 54429 - RNA, 1410 nt, Artificial Sequence; identical to SEQ ID NO: 54357
  neuraminidase__InfluenzaA__AGW01682

SEQ ID NO: 54430 - RNA, 1410 nt, Artificial Sequence
  neuraminidase__InfluenzaA__AGW01704
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuauaggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54431 - RNA, 1410 nt, Artificial Sequence
  neuraminidase__InfluenzaA__AGW01716
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcagaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54432 - RNA, 1410 nt, Artificial Sequence
  neuraminidase__InfluenzaA__AGW01728
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguguuguuguguuuuguggcaccucagguacauauggaacaggcucauggccugauggggcggaccucaaucucaugccuauauaa

SEQ ID NO: 54433 - RNA, 1410 nt, Artificial Sequence
  neuraminidase__InfluenzaA__AGW01740
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54434 - RNA, 1410 nt, Artificial Sequence
  neuraminidase__InfluenzaA__AGW01752
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauuggaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54435 - RNA, 1410 nt, Artificial Sequence; identical to SEQ ID NO: 54357
  neuraminidase__InfluenzaA__AGW01764

SEQ ID NO: 54436 - RNA, 1410 nt, Artificial Sequence
  neuraminidase__InfluenzaA__AGW01776
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaaguguguauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54437 - RNA, 1410 nt, Artificial Sequence; identical to SEQ ID NO: 54375
  neuraminidase__InfluenzaA__AGW01788

SEQ ID NO: 54438 - RNA, 1410 nt, Artificial Sequence; identical to SEQ ID NO: 54387
  neuraminidase__InfluenzaA__AGW01800

SEQ ID NO: 54439 - RNA, 1410 nt, Artificial Sequence
  neuraminidase__InfluenzaA__AGW01812
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacauuugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 54440 - RNA, 1410 nt, Artificial Sequence; identical to SEQ ID NO: 54375
  neuraminidase__InfluenzaA__AGW01824

SEQ ID NO: 54441 - RNA, 1410 nt, Artificial Sequence
  neuraminidase__InfluenzaA__AGW01848
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgguccugacaaguguuaucaauuugcccuuggacagggaacaacacuaaacaacaugcauucaaauaacacaguucgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaggagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54442 - RNA, 1410 nt, Artificial Sequence
  neuraminidase__InfluenzaA__AGW01860
augaauccaaaucaaaagauaauaacgauuggcucuguuucucucaccauuuccacaauaugcuucuucaugcaaauugccaucuugauaacuacuguaacauugcauuucaagcaauaugaauucaacucccucccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacucuauugaugaaugaguuggguguuccuuuucaucuggggaccaagcaaguguguauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuugauccuaacaaugaagaagguggucauggagugaaaggcugggccuuugaugauggaaaugacguguggaugggaagaacaaucaacgagacgucacgcuuaggguaugaaaccuucaaagucauuggaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuauuguguuuuguggcaccucagguacauauggaacaggcucauggccugauggggcggaccucaaucucaugccuauauaa

SEQ ID NO: 54443 - RNA, 1410 nt, Artificial Sequence
  neuraminidase__InfluenzaA__AGW01884
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacaaagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguccauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcacaucagguacauauggaacaggcucauggccugauggggcggaccucaaucucaugccuauauaa

SEQ ID NO: 54444 - RNA, 1410 nt, Artificial Sequence
  neuraminidase__InfluenzaA__AGW01896
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54445 - RNA, 1410 nt, Artificial Sequence
  neuraminidase__InfluenzaA__AGW01908
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaggaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54446 - RNA, 1410 nt, Artificial Sequence; identical to SEQ ID NO: 54357
  neuraminidase__InfluenzaA__AGW01920

SEQ ID NO: 54447 - RNA, 1410 nt, Artificial Sequence
  neuraminidase__InfluenzaA__AGW01932
augaauccaaaucaaaagauaauaacgauuggcucuguuucucucaccauuuccacaauaugcuucuucaugcaaauugccaucuuaauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54448 - RNA, 1410 nt, Artificial Sequence
  neuraminidase__InfluenzaA__AGW01944
augaauccaaaucaaaagauaauaacgauuggcucuguuucucucaccauuuccacaauaugcuucuucaugcaaauugccaucuugauaacuacuguaacauugcauuucaagcaauaugaauucaacuuccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggcuccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54449 - RNA, 1410 nt, Artificial Sequence
  neuraminidase__InfluenzaA__AGW01956
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54450 - RNA, 1410 nt, Artificial Sequence
  neuraminidase__InfluenzaA__AGW01968
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaauacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugaugaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54451 - RNA, 1410 nt, Artificial Sequence; identical to SEQ ID NO: 54375
  neuraminidase__InfluenzaA__AGW01980

SEQ ID NO: 54452 - RNA, 1410 nt, Artificial Sequence; identical to SEQ ID NO: 54357
  neuraminidase__InfluenzaA__AGW01992

SEQ ID NO: 54453 - RNA, 1410 nt, Artificial Sequence; identical to SEQ ID NO: 54361
  neuraminidase__InfluenzaA__AGW02004

SEQ ID NO: 54454 - RNA, 1410 nt, Artificial Sequence
  neuraminidase__InfluenzaA__AGW02016
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcccagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54455 - RNA, 1410 nt, Artificial Sequence
  neuraminidase__InfluenzaA__AGW02040
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaauggaaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54456 - RNA, 1410 nt, Artificial Sequence
  neuraminidase__InfluenzaA__AGW02064
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 54457 - RNA, 1410 nt, Artificial Sequence; identical to SEQ ID NO: 54357
  neuraminidase__InfluenzaA__AGW02076

SEQ ID NO: 54458 - RNA, 1410 nt, Artificial Sequence; identical to SEQ ID NO: 54357
  neuraminidase__InfluenzaA__AGW02088

SEQ ID NO: 54459 - RNA, 1410 nt, Artificial Sequence
  neuraminidase__InfluenzaA__AGW02100
augaauccaaaucaaaagauaauaacgauuggcucuguuucucucaccauuuccacaauaugcuucuucaugcaaauugccaucuugauaacuacuguaacauugcauuucaagcaauaugaauccaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54460 - RNA, 1410 nt, Artificial Sequence; identical to SEQ ID NO: 54387
  neuraminidase__InfluenzaA__AGW02112

SEQ ID NO: 54461 - RNA, 1410 nt, Artificial Sequence
  neuraminidase__InfluenzaA__AGW02124
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguaagugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54462 - RNA, 1410 nt, Artificial Sequence; identical to SEQ ID NO: 54375
  neuraminidase__InfluenzaA__AGW02136

SEQ ID NO: 54463 - RNA, 1410 nt, Artificial Sequence; identical to SEQ ID NO: 54387
  neuraminidase__InfluenzaA__AGW02148

SEQ ID NO: 54464 - RNA, 1410 nt, Artificial Sequence
  neuraminidase__InfluenzaA__AGW02160
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaagugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 54465 - RNA, 1410 nt, Artificial Sequence
  neuraminidase__InfluenzaA__AGW02172
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaaggacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54466 - RNA, 1410 nt, Artificial Sequence; identical to SEQ ID NO: 54361
  neuraminidase__InfluenzaA__AGW02184

SEQ ID NO: 54467 - RNA, 1410 nt, Artificial Sequence
  neuraminidase__InfluenzaA__AGW02196
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaucaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccuacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagacaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54468 - RNA, 1410 nt, Artificial Sequence
  neuraminidase__InfluenzaA__AGW04174
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcucaagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54469 - RNA, 1410 nt, Artificial Sequence
  neuraminidase__InfluenzaA__AGW25784
augaauccaaaucaaaagauaauaacgauuggcucuguuucucucauuauugccacaauaugcuuccuuaugcaaauugccauccugguaacuaccgugacauugcauuuuaagcaauauggauacaauucccucccaaacaaccaaguaaugcugugugaaccaacaauaauagaaagaaacauaacagagauaguguaucugaccaacaccaccauagagaaggagauaugccccaaauuagcagaauacagaaauuggucaaagccgcaauguaagauuacaggauuugcaccuuuuucuaaggacaauucaauccggcuuuccgcugguggggacauuugggugacaagggaaccuuaugugucaugcgauccuuacaaguguuaucaauuugcccuuggacagggaacaacacuaaacaauaagcacucaaaugacacaguacaugauaggaccccuuaucgaacccuauugaugaaugaauuagguguuccauuucauuuaggaaccaagcaaguaugcauagcaugguccaguucaaguugucacgauggaaaagcauggcugcauauuuguguaacugggcacgaugaaaaugcaacugcuagcuucauuuacgaugggaagcuuguagauaguauuggcucaugguccaaaaaaauccuuaggacccaggagucggaaugcguuugcaucaauggaacuuguacagugguaaugacugaugggagugcuucaggaagagcugauaccaaaauauuauuuauugaggaggggaaaaucauucauauuagccaauugucaggaagugcucagcaugucgaggaauguucuuguuacccucgauauccugguauuagaugcgucugcagagacaacuggaaaggcuccaauaggcccauuguagauauaaauguaaaggauuauagcauuacuuccaguuaugugugcucaggacuuguuggagacacacccagaaaaaccgacaacuccagcaguagccauugccugaauccuaacaaugaggaagguggccauggagugaaaggcugggccuuugaugauggaaaugacguguggaugggaagaacgaucagcgagaaauuccgcucagguuaugaaaccuucaaagucaucaaaggcugguccaaaccuaacuccaaauugcagauaaauaggcaagucauaguugacagagauaauagguccgguuacucugguauuuuuucuguugaaggcaaaagcugcaucaaucgguguuuuuauguggaauugauaagaggaaggaaacgggaagcugaagucugguggaccucaaacagcauuguuguguuuuguggcacaucaggaacauauggaacaggcucauggccugauggggcggacaucaaucucaugccuauauaa

SEQ ID NO: 54470 - RNA, 1350 nt, Artificial Sequence
  neuraminidase__InfluenzaA__AGW27062
augaauccaaaucagaagauaguaaccauuggaucaaucuguaugguaauuggaacaauuagcuugauguuacagauugggaacauaaucucaauaugggucagucauucaauccaaacagggaaucaacaccaaacugaaccaaucagaaauacuaauuuucuuacugagaacgcuguagcuucaguaacauuagcuggcaauucaucucuuugccccauuagaggaugggcuguacacaguaaagacaacaguauaaggauuggguccaagggggauguguuuguaauuagagagccguucaucucaugcucccaucuggaaugcagaacuuucuuuuugacucagggagcuuuacugaaugacaagcacuccaacggaacugucaaagauaggagcccucacagaacgcuaaugaguugucccauaggugaggcucccuccccauauaacucgagguuugagucuguugcuuggucggcaagugcuugccaugauggcaccagcugguugguaauuggaauuucugguccagacaauggggcuguggcgguauugaaauacaauggcauaauaacagacacuaucaggaguuggaggaauaacauacugaggacccaagagucugaaugugcauguguaaauggcucuugcuuuacugugaugacagauggaccaaguaaugggcaggcaucauauaagauuuucaaaauagaaaaagggaaaguaguuaagucagucgaauugaaugcuccuaauuaucacuaugaggaaugcuccuguuauccugaugcuggcgaaaucacaugugugugcagggauaauuggcauggcucaaacaggccauggguaucuuucaaucagaauuuggaguaucaaauaggauacauuugcaguggaguuuucggagacaauccacgaccaaaugacggaacagguaguugugguccaguguccucuaacggggcauaugggguaaaaggguucucauuuaaauacggcaauggugucuggaucgggaggaccaaaagcacucauuccaggagcggcuuugaaaugauuugggauccaaacggguggacuggaacggacagugaauuuucgaugaaacaagauauaguagcaauaacugauuggucaggauacagcgggaguuuuguccagcacccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 54471 - RNA, 1410 nt, Artificial Sequence
  neuraminidase__InfluenzaA__AGY14472
augaauccaaaucaaaagauaauaacgauuggcucuguuucucucacccuugccacaauaugcuuccuuaugcaaauagccaucuugguaacuacuguaacauugcauuucaagcaauaugaaugcaacuccaccccaaacaaccaaguaaugcugugugagccaacaguaauagaaagaaauauaacaaagauaguguaucugaccaacaccacuguagagaaggaaauaugccccaaaccagcagaauacagaaauuggucaaagccacaauguaaaaucacuggauuugcuccuuuuucuaaggacaacucaauccggcuuucugccgguggagacauuuggguaacaagagaaccuuauguaucaugcgauccuaacaaguguuaucaauuugcccuuggacagggaacaacauuaaauaacaggcauucaaaugacacagugcaugauagaaccccuuaucgaacccuauugaugaaugaguuggguaucccauuucauuugggaaccaaacaagugugcauagcaugguccagcucaaguugucacgacggaaaagcauggcugcacguuuguguaacugggcaugauaaaaaugcaacugccagcuucauuuacgaugggaagcuuguagauaguauuggcucaugguccaaaaaaauccuuaggacccaggagucggaaugcguuugcaucaauggaacuuguacagugguaaugacugaugggagugcuucaggaagagcugauaccaaaauauuauuuauugaggaggggaaaaucauucauauuagccaauugucaggaagugcucagcaugucgaggaauguucuuguuacccucgauauccugguauuagaugcgucugcagagacaacuggaaaggcuccaauaggcccauuguagauauaaauguaaaggauuauagcauuacuuccaguuaugugugcucaggacuuguuggagacacacccagaaaaaccgacaacuccagcaguagccauugccugaauccuaacaaugaggaagguggccauggagugaaaggcugggccuuugaugauggaaaugacguguggaugggaagaacgaucagcgagaaauuccgcucagguuaugaaaccuucaaagucaucaaaggcugguccaaaccuaacuccaaauugcagauaaauaggcaagucauaguugacagagauaauagguccgguuacucugguauuuuuucuguugaaggcaaaagcugcaucaaucgguguuuuuauguggaauugauaagaggaaggaaacgggaagcugaagucugguggaccucaaacagcauuguuguguuuuguggcacaucaggaacauauggaacaggcucauggccugauggggcggacaucaaucucaugccuauauaa

SEQ ID NO: 54472 - RNA, 1398 nt, Artificial Sequence
  neuraminidase__InfluenzaA__AHA11501
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaauaguguucaccgaugggucugccacuggaccugcagacacaagaauauacuauuuuaaagaggggaaaauauuggaaugggagucucugacuggaacugcuaagcauauagaagaaugcucauguuacggagaacgaacaggaauuaccugcacaugcagggacaauuggcagggcucaaauagaccagugauucagauagacccaguagcaaugacacacacuagucaauauauaugcaguccuguucuuacagacacuccccgaccgaaugacccaaauauagguaaguguaaugacccuuauccagguaaugacaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuagaauagaguacuuccucuaa

SEQ ID NO: 54473 - RNA, 1410 nt, Artificial Sequence
  neuraminidase__InfluenzaA__AHC57462
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaagcugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuugcaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuaugugugcucaggacuuguuggagacacacccagaaaaaacgacagcuccagcaguagccauuguugggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagguaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54474 - RNA, 1410 nt, Artificial Sequence
  neuraminidase__InfluenzaA__AHC57490
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54475 - RNA, 1410 nt, Artificial Sequence
  neuraminidase__InfluenzaA__AHC57514
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54476 - RNA, 1410 nt, Artificial Sequence
  neuraminidase__InfluenzaA__AHC57526
augaacccaaaucaaaagauaauaacgauuggcucuguuucucucaccauuuccacaauaugcuucuucaugcaaauugccaucuugauaacuacuguaacauugcauuucaagcaauacgaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaguugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54477 - RNA, 1410 nt, Artificial Sequence
  neuraminidase__InfluenzaA__AHC57806
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaagacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaaggacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcagaccucaaucucaugccuauauaa

SEQ ID NO: 54478 - RNA, 1410 nt, Artificial Sequence; identical to SEQ ID NO: 54475
  neuraminidase__InfluenzaA__AHC57818

SEQ ID NO: 54479 - RNA, 1410 nt, Artificial Sequence
  neuraminidase__InfluenzaA__AHC57830
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54480 - RNA, 1410 nt, Artificial Sequence; identical to SEQ ID NO: 54479
  neuraminidase__InfluenzaA__AHC57971

SEQ ID NO: 54481 - RNA, 1410 nt, Artificial Sequence; identical to SEQ ID NO: 54475
  neuraminidase__InfluenzaA__AHC57984

SEQ ID NO: 54482 - RNA, 1410 nt, Artificial Sequence
  neuraminidase__InfluenzaA__AHC57996
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccccaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54483 - RNA, 1410 nt, Artificial Sequence
  neuraminidase__InfluenzaA__AHC58008
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54484 - RNA, 1410 nt, Artificial Sequence
  neuraminidase__InfluenzaA__AHC58020
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaaguuauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54485 - RNA, 1410 nt, Artificial Sequence
  neuraminidase__InfluenzaA__AHC58032
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuugaauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54486 - RNA, 1410 nt, Artificial Sequence
  neuraminidase__InfluenzaA__AHC58053
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucuaaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54487 - RNA, 1410 nt, Artificial Sequence
  neuraminidase__InfluenzaA__AHC58077
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugcgugaaccaacaauaauagaaagaaacauaacagagauaguguaucugaccaacaccaccacagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54488 - RNA, 1410 nt, Artificial Sequence
  neuraminidase__InfluenzaA__AHC58089
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccucaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54489 - RNA, 1410 nt, Artificial Sequence; identical to SEQ ID NO: 54475
  neuraminidase__InfluenzaA__AHC58101

SEQ ID NO: 54490 - RNA, 1410 nt, Artificial Sequence
  neuraminidase__InfluenzaA__AHC58113
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54491 - RNA, 1410 nt, Artificial Sequence; identical to SEQ ID NO: 54475
  neuraminidase__InfluenzaA__AHC58129

SEQ ID NO: 54492 - RNA, 1410 nt, Artificial Sequence
  neuraminidase__InfluenzaA__AHC58153
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaagacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcagaccucaaucucaugccuauauaa

SEQ ID NO: 54493 - RNA, 1410 nt, Artificial Sequence
  neuraminidase__InfluenzaA__AHC58165
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacgagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54494 - RNA, 1410 nt, Artificial Sequence
  neuraminidase__InfluenzaA__AHC58177
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguccauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54495 - RNA, 1410 nt, Artificial Sequence
  neuraminidase__InfluenzaA__AHC58189
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagaugucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54496 - RNA, 1410 nt, Artificial Sequence; identical to SEQ ID NO: 54475
  neuraminidase__InfluenzaA__AHC58201

SEQ ID NO: 54497 - RNA, 1410 nt, Artificial Sequence
  neuraminidase__InfluenzaA__AHC58225
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagaaaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacguugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccaaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguuaacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54498 - RNA, 1410 nt, Artificial Sequence; identical to SEQ ID NO: 54479
  neuraminidase__InfluenzaA__AHC58237

SEQ ID NO: 54499 - RNA, 1410 nt, Artificial Sequence; identical to SEQ ID NO: 54475
  neuraminidase__InfluenzaA__AHC58249

SEQ ID NO: 54500 - RNA, 1410 nt, Artificial Sequence
  neuraminidase__InfluenzaA__AHC58273
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugacaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54501 - RNA, 1410 nt, Artificial Sequence
  neuraminidase__InfluenzaA__AHC58363
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54502 - RNA, 1410 nt, Artificial Sequence
  neuraminidase__InfluenzaA__AHC58375
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccaaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54503 - RNA, 1410 nt, Artificial Sequence
  neuraminidase__InfluenzaA__AHC58387
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54504 - RNA, 1410 nt, Artificial Sequence; identical to SEQ ID NO: 54501
  neuraminidase__InfluenzaA__AHC58399

SEQ ID NO: 54505 - RNA, 1410 nt, Artificial Sequence; identical to SEQ ID NO: 54475
  neuraminidase__InfluenzaA__AHC58411

SEQ ID NO: 54506 - RNA, 1410 nt, Artificial Sequence
  neuraminidase__InfluenzaA__AHC58423
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucagggagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54507 - RNA, 1410 nt, Artificial Sequence; identical to SEQ ID NO: 54501
  neuraminidase__InfluenzaA__AHC58459

SEQ ID NO: 54508 - RNA, 1410 nt, Artificial Sequence
  neuraminidase__InfluenzaA__AHC58471
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagccagugguuuccgugaaauuagcgggcaauucuucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaauggcucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccgugggugucuuucaaccagaaucuggaauaucagauaggguacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54509 - RNA, 1410 nt, Artificial Sequence; identical to SEQ ID NO: 54477
  neuraminidase__InfluenzaA__AHC58482

SEQ ID NO: 54510 - RNA, 1410 nt, Artificial Sequence
  neuraminidase__InfluenzaA__AHC58494
augaauccaaaucaaaagauaauaacaauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54511 - RNA, 1410 nt, Artificial Sequence
  neuraminidase__InfluenzaA__AHC58518
augaacccaaaucaaaagauaauaacgauuggcucuguuucucucaccauuuccacaauaugcuucuucaugcaaguugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54512 - RNA, 1410 nt, Artificial Sequence; identical to SEQ ID NO: 54475
  neuraminidase__InfluenzaA__AHC58530

SEQ ID NO: 54513 - RNA, 1410 nt, Artificial Sequence; identical to SEQ ID NO: 54492
  neuraminidase__InfluenzaA__AHC58554

SEQ ID NO: 54514 - RNA, 1410 nt, Artificial Sequence
  neuraminidase__InfluenzaA__AHC58566
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaagacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54515 - RNA, 1410 nt, Artificial Sequence
  neuraminidase__InfluenzaA__AHC58578
augaacccaaaucaaaagauaauaacgauuggcucuguuucucucaccguuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuacguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54516 - RNA, 1410 nt, Artificial Sequence; identical to SEQ ID NO: 54474
  neuraminidase__InfluenzaA__AHC58590

SEQ ID NO: 54517 - RNA, 1410 nt, Artificial Sequence; identical to SEQ ID NO: 54511
  neuraminidase__InfluenzaA__AHC58602

SEQ ID NO: 54518 - RNA, 1410 nt, Artificial Sequence; identical to SEQ ID NO: 54475
  neuraminidase__InfluenzaA__AHC58614

SEQ ID NO: 54519 - RNA, 1410 nt, Artificial Sequence; identical to SEQ ID NO: 54475
  neuraminidase__InfluenzaA__AHC58626

SEQ ID NO: 54520 - RNA, 1410 nt, Artificial Sequence
  neuraminidase__InfluenzaA__AHC58638
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucagggaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54521 - RNA, 1410 nt, Artificial Sequence; identical to SEQ ID NO: 54476
  neuraminidase__InfluenzaA__AHC58650

SEQ ID NO: 54522 - RNA, 1410 nt, Artificial Sequence
  neuraminidase__InfluenzaA__AHC58662
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54523 - RNA, 1410 nt, Artificial Sequence
  neuraminidase__InfluenzaA__AHC58686
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaguggugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucagggagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54524 - RNA, 1410 nt, Artificial Sequence
  neuraminidase__InfluenzaA__AHC58698
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54525 - RNA, 1410 nt, Artificial Sequence
  neuraminidase__InfluenzaA__AHC58710
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54526 - RNA, 1410 nt, Artificial Sequence; identical to SEQ ID NO: 54525
  neuraminidase__InfluenzaA__AHC58722

SEQ ID NO: 54527 - RNA, 1410 nt, Artificial Sequence
  neuraminidase__InfluenzaA__AHC58734
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccugguaucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54528 - RNA, 1410 nt, Artificial Sequence; identical to SEQ ID NO: 54475
  neuraminidase__InfluenzaA__AHC58746

SEQ ID NO: 54529 - RNA, 1410 nt, Artificial Sequence; identical to SEQ ID NO: 54510
  neuraminidase__InfluenzaA__AHC58758

SEQ ID NO: 54530 - RNA, 1410 nt, Artificial Sequence; identical to SEQ ID NO: 54475
  neuraminidase__InfluenzaA__AHC58770

SEQ ID NO: 54531 - RNA, 1410 nt, Artificial Sequence; identical to SEQ ID NO: 51209
  neuraminidase__InfluenzaA__AHC58782

SEQ ID NO: 54532 - RNA, 1410 nt, Artificial Sequence; identical to SEQ ID NO: 54492
  neuraminidase__InfluenzaA__AHC58806

SEQ ID NO: 54533 - RNA, 1410 nt, Artificial Sequence
  neuraminidase__InfluenzaA__AHC58818
augaacccaaaucaaaagauaauaacgauuggcucuguuucucucaccauuuccacaauaugcuucuucauacaaauugccaucuugauaacuacuguaacauugcauuucaagcaauaugaauucaacucccccccaaacaaccaagugaugcugugugaaccaacaauaauagagagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauaguucauacuagcacauugucaggaagugcucagcaugucgaggagugcucuugcuauccucgauaucccggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcagcagccauuguuuggauccuaacaaugaagaagguggucauggagugaaaggcugggccuuugaugauggaaaugacguguggaugggaagaacgaucaacgaaacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54534 - RNA, 1410 nt, Artificial Sequence
  neuraminidase__InfluenzaA__AHC58830
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaagguaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54535 - RNA, 1410 nt, Artificial Sequence; identical to SEQ ID NO: 54475
  neuraminidase__InfluenzaA__AHC58842

SEQ ID NO: 54536 - RNA, 1410 nt, Artificial Sequence
  neuraminidase__InfluenzaA__AHC58866
augaauccaaaucaaaagauaauaacaauuggcucuguuucucucaccauuuccacaauaugcuucuucaugcaaauugccaucuugauaacuacuguaacauuacauuucaagcaaugugaauucaacucccccccaaacaaccgagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguagaguugauuaggggaagaaaagaggaaacuggagucuuguggaccucaaacaguauuguuguguuuuguggcaccucagguacauauggaacaggcucauggccugauggggcggaccucaaucucaugccuauauaa

SEQ ID NO: 54537 - RNA, 1410 nt, Artificial Sequence; identical to SEQ ID NO: 54534
  neuraminidase__InfluenzaA__AHC58878

SEQ ID NO: 54538 - RNA, 1410 nt, Artificial Sequence; identical to SEQ ID NO: 54475
  neuraminidase__InfluenzaA__AHC58890

SEQ ID NO: 54539 - RNA, 1410 nt, Artificial Sequence
  neuraminidase__InfluenzaA__AHC58902
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggagaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54540 - RNA, 1410 nt, Artificial Sequence
  neuraminidase__InfluenzaA__AHC58996
augaacccaaaucaaaagauaauaacgauuggcucuguuucucucaccauuuccacaauaugcuucuucaugcaaauugccaucuugauaacuacuguaacauugcauuucaagcaauacgaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54541 - RNA, 1410 nt, Artificial Sequence; identical to SEQ ID NO: 54475
  neuraminidase__InfluenzaA__AHC59008

SEQ ID NO: 54542 - RNA, 1410 nt, Artificial Sequence
  neuraminidase__InfluenzaA__AHC59020
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauuacagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54543 - RNA, 1410 nt, Artificial Sequence
  neuraminidase__InfluenzaA__AHC59032
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuagugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54544 - RNA, 1410 nt, Artificial Sequence; identical to SEQ ID NO: 54511
  neuraminidase__InfluenzaA__AHC59044

SEQ ID NO: 54545 - RNA, 1410 nt, Artificial Sequence; identical to SEQ ID NO: 51209
  neuraminidase__InfluenzaA__AHC59056

SEQ ID NO: 54546 - RNA, 1410 nt, Artificial Sequence; identical to SEQ ID NO: 54475
  neuraminidase__InfluenzaA__AHC59068

SEQ ID NO: 54547 - RNA, 1410 nt, Artificial Sequence; identical to SEQ ID NO: 54475
  neuraminidase__InfluenzaA__AHC59080

SEQ ID NO: 54548 - RNA, 1410 nt, Artificial Sequence
  neuraminidase__InfluenzaA__AHC59092
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucuguagagacaacuggaaaggcuccaauaggcccaucguagauauaaacauaaaggaucauagcauugucuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54549 - RNA, 1410 nt, Artificial Sequence
  neuraminidase__InfluenzaA__AHC59104
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauaaaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54550 - RNA, 1410 nt, Artificial Sequence
  neuraminidase__InfluenzaA__AHC59116
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagagaagaggaaacugaagucuuguggaccucaaacaguauuguuguguuuuguggcaccucagguacauauggaacaggcucauggccugauggggcggaccucaaucucaugccuauauaa

SEQ ID NO: 54551 - RNA, 1410 nt, Artificial Sequence
  neuraminidase__InfluenzaA__AHC59128
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauggaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgacccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucgaugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54552 - RNA, 1410 nt, Artificial Sequence
  neuraminidase__InfluenzaA__AHC59152
augaacccaaaucaaaagauaauaacgauuggcucuguuucucucaccauuuccacaauaugcuucuucaugcaaguugccaucuugauaacuacuguaacauugcauuucaagcaauaugaauucaacucccccccaaacaaccaagugaugcugugugaaccaacaauaauagaaagaaacauaacagagauauuguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54553 - RNA, 1410 nt, Artificial Sequence
  neuraminidase__InfluenzaA__AHC59188
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaaguggugcugugugaaccaacaauaauagaaagaaacaucacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacacugucgggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54554 - RNA, 1410 nt, Artificial Sequence
  neuraminidase__InfluenzaA__AHC59200
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54555 - RNA, 1410 nt, Artificial Sequence
  neuraminidase__InfluenzaA__AHC59212
augaauccaaaucaaaagauaauaacgauuggcucuguuucucucaccauuuccacaauaugcuucuucaugcaaauugccaccuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaagcugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuugcaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54556 - RNA, 1410 nt, Artificial Sequence; identical to SEQ ID NO: 54479
  neuraminidase__InfluenzaA__AHC59224

SEQ ID NO: 54557 - RNA, 1410 nt, Artificial Sequence
  neuraminidase__InfluenzaA__AHC59236
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacaugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54558 - RNA, 1410 nt, Artificial Sequence; identical to SEQ ID NO: 54501
  neuraminidase__InfluenzaA__AHC59260

SEQ ID NO: 54559 - RNA, 1410 nt, Artificial Sequence; identical to SEQ ID NO: 54540
  neuraminidase__InfluenzaA__AHC59272

SEQ ID NO: 54560 - RNA, 1410 nt, Artificial Sequence
  neuraminidase__InfluenzaA__AHC59284
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugaucaggggaagaaaagaggaaacugaagucuuguggaccucaaacaguauuguuguguuuugugguaccucagguacauauggaacaggcucauggccugauggggcggaccucaaucucaugccuauauaa

SEQ ID NO: 54561 - RNA, 1410 nt, Artificial Sequence
  neuraminidase__InfluenzaA__AHC59296
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaaaauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54562 - RNA, 1410 nt, Artificial Sequence
  neuraminidase__InfluenzaA__AHC59308
augaauccaaaucaaaagauaauaacgauuggcucuguuucucucaccauuuccacaauaugcuucuucaugcaaauugccaucuugauaaccacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucaugguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54563 - RNA, 1410 nt, Artificial Sequence
  neuraminidase__InfluenzaA__AHC59320
augaauccaaaucaaaagauaauaacgauuggcucuguuucucucaccauuuccacaauaugcuucuucaugcaaauugccaucuugauaacuacuguaacauugcauuucaagcaauaugaauucaacuccccuccaaacaaccaagugaugcugugugaaccaacaauaauagaaagaaacauaacagagauaguguaucugaccaacacaaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacccuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54564 - RNA, 1410 nt, Artificial Sequence
  neuraminidase__InfluenzaA__AHC59332
augaauccaaaucaaaagauaauaacgauuggcucuguuucucucaccauuuccacaauaugcuucuucaugcaaauugccaucuugauaacuacuguaacauugcauuucaagcaauaugaauucaacuccccuccaaacaaccaagugaugcugugugaaccaacaauaauagaaagaaacauaacagagauaguguaucugaccaacacaaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54565 - RNA, 1410 nt, Artificial Sequence
  neuraminidase__InfluenzaA__AHC59344
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaguggugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54566 - RNA, 1410 nt, Artificial Sequence
  neuraminidase__InfluenzaA__AHC59368
augaauccaaaucaaaagauaauaacaauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucgacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54567 - RNA, 1410 nt, Artificial Sequence; identical to SEQ ID NO: 54475
  neuraminidase__InfluenzaA__AHC59380

SEQ ID NO: 54568 - RNA, 1410 nt, Artificial Sequence; identical to SEQ ID NO: 54525
  neuraminidase__InfluenzaA__AHC59392

SEQ ID NO: 54569 - RNA, 1410 nt, Artificial Sequence
  neuraminidase__InfluenzaA__AHC59404
augaacccaaaucaaaagauaauaacgauuggcucuguuucucucaccauuuccacaauaugcuuuuucaugcaaguugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54570 - RNA, 1410 nt, Artificial Sequence; identical to SEQ ID NO: 54479
  neuraminidase__InfluenzaA__AHC59416

SEQ ID NO: 54571 - RNA, 1410 nt, Artificial Sequence
  neuraminidase__InfluenzaA__AHC59428
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacagguguuaucaauuugcccuuggacagggaacaacacuaaacaacgugcauucaaauaacacaguacgugauaggaccccuuaucggacccuauugaugaaugaguuagguguuccuuuucaucuggggacaaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaaguaauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54572 - RNA, 1410 nt, Artificial Sequence
  neuraminidase__InfluenzaA__AHC59440
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucagacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54573 - RNA, 1410 nt, Artificial Sequence
  neuraminidase__InfluenzaA__AHC59452
augaauccaaaucaaaagauaauaacgauuggcucuguuucucucaccauuucaacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54574 - RNA, 1410 nt, Artificial Sequence
  neuraminidase__InfluenzaA__AHC59464
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaauguguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54575 - RNA, 1410 nt, Artificial Sequence; identical to SEQ ID NO: 54563
  neuraminidase__InfluenzaA__AHC59476

SEQ ID NO: 54576 - RNA, 1410 nt, Artificial Sequence
  neuraminidase__InfluenzaA__AHC59488
augaauccaaaucaaaagauaauaacgauuggcucuguuucucucaccauuuccacaauaugcuucuucaugcaaauugccaucuugauaacuacuguaacauugcauuucaagcaauaugaauucaacuccccuccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54577 - RNA, 1410 nt, Artificial Sequence; identical to SEQ ID NO: 54479
  neuraminidase__InfluenzaA__AHC59500

SEQ ID NO: 54578 - RNA, 1410 nt, Artificial Sequence
  neuraminidase__InfluenzaA__AHC59512
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaagguaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54579 - RNA, 1410 nt, Artificial Sequence; identical to SEQ ID NO: 54524
  neuraminidase__InfluenzaA__AHC59524

SEQ ID NO: 54580 - RNA, 1410 nt, Artificial Sequence
  neuraminidase__InfluenzaA__AHC59536
augaacccaaaccaaaagauaauaacgauuggcucuguuucucucaccauuuccacaauaugcuucuucaugcaaguugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54581 - RNA, 1410 nt, Artificial Sequence; identical to SEQ ID NO: 54479
  neuraminidase__InfluenzaA__AHC59548

SEQ ID NO: 54582 - RNA, 1410 nt, Artificial Sequence; identical to SEQ ID NO: 54501
  neuraminidase__InfluenzaA__AHC59560

SEQ ID NO: 54583 - RNA, 1410 nt, Artificial Sequence; identical to SEQ ID NO: 54557
  neuraminidase__InfluenzaA__AHC59572

SEQ ID NO: 54584 - RNA, 1410 nt, Artificial Sequence
  neuraminidase__InfluenzaA__AHC59584
augaacccaaaucaaaagauaauaacgauuggcucuguuucucucaccauuuccacaauaugcuucuucaugcaaguugccaucuugauaacuacuguaacauugcauuucaagcaauaugaauucaacucccccccaaacaaccaagugaugcugugugaaccaacaauaauagaaagaaacauaacagagauauuguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggaucccaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54585 - RNA, 1410 nt, Artificial Sequence
  neuraminidase__InfluenzaA__AHC59596
augaauccaaaucaaaagauaauaacgauuggcucuguuucucucaccauuuccacaauaugcuucuucaugcaaauugccaucuugauaacuacuguaacauugcauuucaagcaauaugaauucaacucccccccgaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaagguaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54586 - RNA, 1410 nt, Artificial Sequence
  neuraminidase__InfluenzaA__AHC59608
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucuguagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54587 - RNA, 1410 nt, Artificial Sequence; identical to SEQ ID NO: 54511
  neuraminidase__InfluenzaA__AHC59620

SEQ ID NO: 54588 - RNA, 1410 nt, Artificial Sequence; identical to SEQ ID NO: 54479
  neuraminidase__InfluenzaA__AHC59632

SEQ ID NO: 54589 - RNA, 1410 nt, Artificial Sequence
  neuraminidase__InfluenzaA__AHC59644
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauucucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54590 - RNA, 1410 nt, Artificial Sequence
  neuraminidase__InfluenzaA__AHC59656
augaauccaaaucaaaagauaauaacgauuggcucuguuucucucaccauuuccacaauaugcuucuucaugcaaauugccaucuugauaacuacuguaacaaugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugucaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54591 - RNA, 1410 nt, Artificial Sequence; identical to SEQ ID NO: 54524
  neuraminidase__InfluenzaA__AHC59668

SEQ ID NO: 54592 - RNA, 1410 nt, Artificial Sequence
  neuraminidase__InfluenzaA__AHC59680
augaacccaaaucaaaagauaauaacgauuggcucuguuucucucaccauuuccacaauaugcuucuucaugcaaguugccaucuugauaacuacuguaacauugcauuucaagcaauaugaauucaacucccccccaaacaaccaagugaugcugugugaaccaacaauaauagaaagaaacauaacagagauauuguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucauuuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54593 - RNA, 1410 nt, Artificial Sequence; identical to SEQ ID NO: 54539
  neuraminidase__InfluenzaA__AHC59704

SEQ ID NO: 54594 - RNA, 1410 nt, Artificial Sequence; identical to SEQ ID NO: 51209
  neuraminidase__InfluenzaA__AHC59716

SEQ ID NO: 54595 - RNA, 1410 nt, Artificial Sequence; identical to SEQ ID NO: 51209
  neuraminidase__InfluenzaA__AHC59728

SEQ ID NO: 54596 - RNA, 1410 nt, Artificial Sequence; identical to SEQ ID NO: 54534
  neuraminidase__InfluenzaA__AHC59752

SEQ ID NO: 54597 - RNA, 1410 nt, Artificial Sequence
  neuraminidase__InfluenzaA__AHC59764
augaacccaaaucaaaagauaauaacgauuggcucuguuucucucaccauuuccacaauaugcuucuucaugcaaguugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaagguuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54598 - RNA, 1410 nt, Artificial Sequence
  neuraminidase__InfluenzaA__AHC59776
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaaguuuuguggaccucaaacaguauuguuguguuuuguggcaccucagguacauauggaacaggcucauggccugauggggcggaccucaaucucaugccuauauaa

SEQ ID NO: 54599 - RNA, 1410 nt, Artificial Sequence; identical to SEQ ID NO: 54475
  neuraminidase__InfluenzaA__AHC59788

SEQ ID NO: 54600 - RNA, 1410 nt, Artificial Sequence; identical to SEQ ID NO: 54552
  neuraminidase__InfluenzaA__AHC59800

SEQ ID NO: 54601 - RNA, 1410 nt, Artificial Sequence
  neuraminidase__InfluenzaA__AHC59812
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaguggugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguuuauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54602 - RNA, 1410 nt, Artificial Sequence
  neuraminidase__InfluenzaA__AHC59824
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaaauggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgaugggaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54603 - RNA, 1410 nt, Artificial Sequence; identical to SEQ ID NO: 54589
  neuraminidase__InfluenzaA__AHC59836

SEQ ID NO: 54604 - RNA, 1410 nt, Artificial Sequence
  neuraminidase__InfluenzaA__AHC59848
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagaaaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucucaaguuauguguguucaggacuuguuggagacacacccagaaaaaacgacagcuccagcaguagccauuguuuggauccaaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguagaguugauuaggggaagaaaagaggaaacugaagucuuguggaccucaaacaguauuguuguguuuuguggcaccucggguacauauggaacaggcucauggccugauggggcggaccucaaucucaugccuauauaa

SEQ ID NO: 54605 - RNA, 1410 nt, Artificial Sequence; identical to SEQ ID NO: 54475
  neuraminidase__InfluenzaA__AHC59860

SEQ ID NO: 54606 - RNA, 1410 nt, Artificial Sequence
  neuraminidase__InfluenzaA__AHC59872
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuguugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54607 - RNA, 1410 nt, Artificial Sequence; identical to SEQ ID NO: 54511
  neuraminidase__InfluenzaA__AHC59884

SEQ ID NO: 54608 - RNA, 1410 nt, Artificial Sequence
  neuraminidase__InfluenzaA__AHC59895
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucagaacccaggagucagaaugcguuuguaucaauggaacuuguacaguaguaaugacugaugggagugcuucaggaaaagcugauacuaaaauacuauucauuaaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54609 - RNA, 1410 nt, Artificial Sequence
  neuraminidase__InfluenzaA__AHC59907
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuaggugucccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54610 - RNA, 1410 nt, Artificial Sequence
  neuraminidase__InfluenzaA__AHC59918
augaacccaaaucaaaagauaauaacgauuggcucuguuucucucaccauuuccacaauaugcuucuucauacaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuagacuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauaucccggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcagcagccauuguuuggauccuaacaaugaagaagguggucauggagugaaaggcugggccuucgaugauggaaaugacguguggaugggaagaacgaucaacgagacgucacgcuuaggguacgaaaccuucaaagucauugaaggcugguccaacccuaaguccaaauugcagaugaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54611 - RNA, 1410 nt, Artificial Sequence; identical to SEQ ID NO: 54610
  neuraminidase__InfluenzaA__AHC59930

SEQ ID NO: 54612 - RNA, 1410 nt, Artificial Sequence; identical to SEQ ID NO: 54479
  neuraminidase__InfluenzaA__AHC59942

SEQ ID NO: 54613 - RNA, 1410 nt, Artificial Sequence; identical to SEQ ID NO: 54585
  neuraminidase__InfluenzaA__AHC59954

SEQ ID NO: 54614 - RNA, 1410 nt, Artificial Sequence
  neuraminidase__InfluenzaA__AHC59966
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauggguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54615 - RNA, 1410 nt, Artificial Sequence
  neuraminidase__InfluenzaA__AHC59978
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauuacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaagaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaauccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54616 - RNA, 1410 nt, Artificial Sequence
  neuraminidase__InfluenzaA__AHC59990
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaguuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugccacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauuccgguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54617 - RNA, 1410 nt, Artificial Sequence; identical to SEQ ID NO: 54534
  neuraminidase__InfluenzaA__AHC60002

SEQ ID NO: 54618 - RNA, 1410 nt, Artificial Sequence; identical to SEQ ID NO: 54479
  neuraminidase__InfluenzaA__AHC60014

SEQ ID NO: 54619 - RNA, 1410 nt, Artificial Sequence; identical to SEQ ID NO: 51209
  neuraminidase__InfluenzaA__AHC60026

SEQ ID NO: 54620 - RNA, 1410 nt, Artificial Sequence; identical to SEQ ID NO: 54475
  neuraminidase__InfluenzaA__AHC60038

SEQ ID NO: 54621 - RNA, 1410 nt, Artificial Sequence; identical to SEQ ID NO: 54475
  neuraminidase__InfluenzaA__AHC60050

SEQ ID NO: 54622 - RNA, 1410 nt, Artificial Sequence
  neuraminidase__InfluenzaA__AHC60062
augaauccaaaucaaaagauaauaacgauuggcucuguuucucucaccauuuccacaauaugcuucuucaugcaaauugccaucuugauaacuacuguaacaaugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaauuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54623 - RNA, 1410 nt, Artificial Sequence; identical to SEQ ID NO: 54483
  neuraminidase__InfluenzaA__AHC60074

SEQ ID NO: 54624 - RNA, 1410 nt, Artificial Sequence; identical to SEQ ID NO: 54501
  neuraminidase__InfluenzaA__AHC60086

SEQ ID NO: 54625 - RNA, 1410 nt, Artificial Sequence
  neuraminidase__InfluenzaA__AHC60098
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugauggaagugcuucaggaaaagcugauacuaaaauacuauucauugaggaagggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucgacgagacgucacgcuuaggguaugaaaccuucaaagucauugaaggcugguccaacccuaagucaaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54626 - RNA, 1410 nt, Artificial Sequence; identical to SEQ ID NO: 54492
  neuraminidase__InfluenzaA__AHC60110

SEQ ID NO: 54627 - RNA, 1410 nt, Artificial Sequence; identical to SEQ ID NO: 54552
  neuraminidase__InfluenzaA__AHC60122

SEQ ID NO: 54628 - RNA, 1410 nt, Artificial Sequence; identical to SEQ ID NO: 54479
  neuraminidase__InfluenzaA__AHC60134

SEQ ID NO: 54629 - RNA, 1410 nt, Artificial Sequence; identical to SEQ ID NO: 54533
  neuraminidase__InfluenzaA__AHC60146

SEQ ID NO: 54630 - RNA, 1410 nt, Artificial Sequence; identical to SEQ ID NO: 54610
  neuraminidase__InfluenzaA__AHC60158

SEQ ID NO: 54631 - RNA, 1410 nt, Artificial Sequence; identical to SEQ ID NO: 54475
  neuraminidase__InfluenzaA__AHC60182

SEQ ID NO: 54632 - RNA, 1410 nt, Artificial Sequence
  neuraminidase__InfluenzaA__AHC60206
augaacccaaaucaaaagauaauaacgauuggcucuguuucucucaccauuuccauaauaugcuucuucaugcaaguugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54633 - RNA, 1410 nt, Artificial Sequence
  neuraminidase__InfluenzaA__AHC60218
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaauuagguguuccuuuucaucuggggaccaagcaagugugcauagcaugguccagcucaaguugucaugauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54634 - RNA, 1410 nt, Artificial Sequence
  neuraminidase__InfluenzaA__AHC60230
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaauguguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagauguguuugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54635 - RNA, 1410 nt, Artificial Sequence; identical to SEQ ID NO: 54475
  neuraminidase__InfluenzaA__AHC60242

SEQ ID NO: 54636 - RNA, 1410 nt, Artificial Sequence
  neuraminidase__InfluenzaA__AHC60254
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacaucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54637 - RNA, 1410 nt, Artificial Sequence
  neuraminidase__InfluenzaA__AHC60266
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugacaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaagggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugauguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54638 - RNA, 1410 nt, Artificial Sequence
  neuraminidase__InfluenzaA__AHC60278
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaagguaaaagcugcaucaaucggugcuuuuauguggaguugauuaggggaagaaaagaggaaacugaagucuuguggaccucaaacaguauuguuguguuuuguggcaccucugguacauauggaacaggcucauggccugauggggcggaccucaaucucaugccuauauaa

SEQ ID NO: 54639 - RNA, 1410 nt, Artificial Sequence; identical to SEQ ID NO: 54492
  neuraminidase__InfluenzaA__AHC60290

SEQ ID NO: 54640 - RNA, 1410 nt, Artificial Sequence
  neuraminidase__InfluenzaA__AHC60302
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucauucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54641 - RNA, 1410 nt, Artificial Sequence; identical to SEQ ID NO: 54475
  neuraminidase__InfluenzaA__AHC60314

SEQ ID NO: 54642 - RNA, 1410 nt, Artificial Sequence; identical to SEQ ID NO: 54475
  neuraminidase__InfluenzaA__AHC60326

SEQ ID NO: 54643 - RNA, 1410 nt, Artificial Sequence
  neuraminidase__InfluenzaA__AHC60338
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggagaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54644 - RNA, 1410 nt, Artificial Sequence
  neuraminidase__InfluenzaA__AHC60350
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaguuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauuccgguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54645 - RNA, 1410 nt, Artificial Sequence
  neuraminidase__InfluenzaA__AHC60362
augaacccaaaucaaaagauaauaacgauuggcucuguuucucucaccauuuccacaauaugcuucuucaugcaaguugccaucuugauaacuacuguaacauugcauuucaagcaauaugaauucaacucccccccaaacaaccaagugaugcuguguaaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54646 - RNA, 1410 nt, Artificial Sequence; identical to SEQ ID NO: 54563
  neuraminidase__InfluenzaA__AHC60374

SEQ ID NO: 54647 - RNA, 1410 nt, Artificial Sequence
  neuraminidase__InfluenzaA__AHC60386
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaauguguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54648 - RNA, 1410 nt, Artificial Sequence; identical to SEQ ID NO: 54479
  neuraminidase__InfluenzaA__AHC60398

SEQ ID NO: 54649 - RNA, 1410 nt, Artificial Sequence; identical to SEQ ID NO: 54580
  neuraminidase__InfluenzaA__AHC60410

SEQ ID NO: 54650 - RNA, 1410 nt, Artificial Sequence
  neuraminidase__InfluenzaA__AHC60422
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgaugggaaagcauggcugcauguuuguauaacgggggaugauaaaaaugcaacugcuagcuucauuuacaaugggaggcuuguagauaguguuguuucaugguccaaagaaauacucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54651 - RNA, 1410 nt, Artificial Sequence; identical to SEQ ID NO: 54511
  neuraminidase__InfluenzaA__AHC60434

SEQ ID NO: 54652 - RNA, 1410 nt, Artificial Sequence; identical to SEQ ID NO: 54501
  neuraminidase__InfluenzaA__AHC60446

SEQ ID NO: 54653 - RNA, 1410 nt, Artificial Sequence
  neuraminidase__InfluenzaA__AHC60458
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacggcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaagguaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54654 - RNA, 1410 nt, Artificial Sequence; identical to SEQ ID NO: 54585
  neuraminidase__InfluenzaA__AHC60470

SEQ ID NO: 54655 - RNA, 1410 nt, Artificial Sequence
  neuraminidase__InfluenzaA__AHC60482
augaauccaaaucaaaagauaauaacgauuggcucuguuucucucaccauuuccacaauaugcuucuucaugcaaauugccaucuugacaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54656 - RNA, 1410 nt, Artificial Sequence; identical to SEQ ID NO: 54475
  neuraminidase__InfluenzaA__AHC60494

SEQ ID NO: 54657 - RNA, 1410 nt, Artificial Sequence
  neuraminidase__InfluenzaA__AHC60506
augaauccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54658 - RNA, 1410 nt, Artificial Sequence; identical to SEQ ID NO: 54479
  neuraminidase__InfluenzaA__AHC60518

SEQ ID NO: 54659 - RNA, 1410 nt, Artificial Sequence
  neuraminidase__InfluenzaA__AHC60542
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugaugggaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54660 - RNA, 1410 nt, Artificial Sequence
  neuraminidase__InfluenzaA__AHC60554
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaaugauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcacauggccugauggggcggaccucaaucucaugccuauauaa

SEQ ID NO: 54661 - RNA, 1410 nt, Artificial Sequence
  neuraminidase__InfluenzaA__AHC60566
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagguaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54662 - RNA, 1410 nt, Artificial Sequence; identical to SEQ ID NO: 54483
  neuraminidase__InfluenzaA__AHC60578

SEQ ID NO: 54663 - RNA, 1410 nt, Artificial Sequence; identical to SEQ ID NO: 54475
  neuraminidase__InfluenzaA__AHC60590

SEQ ID NO: 54664 - RNA, 1410 nt, Artificial Sequence
  neuraminidase__InfluenzaA__AHC60602
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaaguggugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54665 - RNA, 1410 nt, Artificial Sequence
  neuraminidase__InfluenzaA__AHC60614
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54666 - RNA, 1410 nt, Artificial Sequence
  neuraminidase__InfluenzaA__AHC60626
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauuacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaagaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaauccaaauugcagauaaauaggcaagucauaguugacagaggugauagguccgguuauucugguauuuucucuguugaaggaaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54667 - RNA, 1410 nt, Artificial Sequence
  neuraminidase__InfluenzaA__AHC60650
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuugggcagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugaugaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54668 - RNA, 1410 nt, Artificial Sequence
  neuraminidase__InfluenzaA__AHC60662
augaauccaaaucaaaagauaauaacgauuggcucuguuucucucaccauuuccacaauaugcuucuucaugcaaauugccaucuugauaacuacuguaacauugcauuucaagcaauaugaauucaacucccccccgaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaaugagacgucacguuuaggguaugaaaccuucaaagucauugaaggcugguccaacccuaaguccaaauugcagauaaauaggcaagucauaguugacagagguaauagguccgguuauucugguauuuucucuguugaagguaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54669 - RNA, 1410 nt, Artificial Sequence; identical to SEQ ID NO: 54503
  neuraminidase__InfluenzaA__AHC60674

SEQ ID NO: 54670 - RNA, 1410 nt, Artificial Sequence
  neuraminidase__InfluenzaA__AHC60686
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaauguguuuguaucaauggaacuuguacaguaguaaugacugaugggagugcuucaggaaaagcugauacuaaaauacuauucauugaggagggaaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54671 - RNA, 1410 nt, Artificial Sequence; identical to SEQ ID NO: 54501
  neuraminidase__InfluenzaA__AHC60698

SEQ ID NO: 54672 - RNA, 1410 nt, Artificial Sequence; identical to SEQ ID NO: 54520
  neuraminidase__InfluenzaA__AHC60710

SEQ ID NO: 54673 - RNA, 1410 nt, Artificial Sequence; identical to SEQ ID NO: 54585
  neuraminidase__InfluenzaA__AHC60722

SEQ ID NO: 54674 - RNA, 1410 nt, Artificial Sequence
  neuraminidase__InfluenzaA__AHC60734
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaucaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54675 - RNA, 1410 nt, Artificial Sequence; identical to SEQ ID NO: 54580
  neuraminidase__InfluenzaA__AHC60746

SEQ ID NO: 54676 - RNA, 1410 nt, Artificial Sequence
  neuraminidase__InfluenzaA__AHC60770
augaacccaaaucaaaagauaauaacgauuggcucuguuucucucaccauuuccacaauaugcuucuucauacaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauaucccggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcagcagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagaugaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54677 - RNA, 1410 nt, Artificial Sequence
  neuraminidase__InfluenzaA__AHC60782
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccgguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54678 - RNA, 1410 nt, Artificial Sequence; identical to SEQ ID NO: 54606
  neuraminidase__InfluenzaA__AHC60794

SEQ ID NO: 54679 - RNA, 1410 nt, Artificial Sequence
  neuraminidase__InfluenzaA__AHC60806
augaauccaaaucaaaagauaauaacaauuggcucuguuucucucaccauuuccacaauaugcuucuucaugcaaauugccaucuugauaacuacuguaacauuacauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguagaguugauuaggggaagaaaagaggaaacuggagucuuguggaccucaaacaguauuguuguguuuuguggcaccucagguacauauggaacaggcucauggccugauggggcggaccucaaucucaugccuauauaa

SEQ ID NO: 54680 - RNA, 1410 nt, Artificial Sequence; identical to SEQ ID NO: 54644
  neuraminidase__InfluenzaA__AHC60818

SEQ ID NO: 54681 - RNA, 1410 nt, Artificial Sequence; identical to SEQ ID NO: 54501
  neuraminidase__InfluenzaA__AHC60830

SEQ ID NO: 54682 - RNA, 1410 nt, Artificial Sequence; identical to SEQ ID NO: 54660
  neuraminidase__InfluenzaA__AHC60842

SEQ ID NO: 54683 - RNA, 1410 nt, Artificial Sequence; identical to SEQ ID NO: 54479
  neuraminidase__InfluenzaA__AHC60854

SEQ ID NO: 54684 - RNA, 1410 nt, Artificial Sequence
  neuraminidase__InfluenzaA__AHC60866
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagggacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54685 - RNA, 1410 nt, Artificial Sequence; identical to SEQ ID NO: 54511
  neuraminidase__InfluenzaA__AHC60878

SEQ ID NO: 54686 - RNA, 1410 nt, Artificial Sequence; identical to SEQ ID NO: 54597
  neuraminidase__InfluenzaA__AHC60890

SEQ ID NO: 54687 - RNA, 1410 nt, Artificial Sequence; identical to SEQ ID NO: 54676
  neuraminidase__InfluenzaA__AHC60902

SEQ ID NO: 54688 - RNA, 1410 nt, Artificial Sequence; identical to SEQ ID NO: 54475
  neuraminidase__InfluenzaA__AHC60914

SEQ ID NO: 54689 - RNA, 1410 nt, Artificial Sequence
  neuraminidase__InfluenzaA__AHC60926
augaauccaaaucaaaagauaauaacaauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuaguacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54690 - RNA, 1410 nt, Artificial Sequence; identical to SEQ ID NO: 54475
  neuraminidase__InfluenzaA__AHC60938

SEQ ID NO: 54691 - RNA, 1410 nt, Artificial Sequence; identical to SEQ ID NO: 54479
  neuraminidase__InfluenzaA__AHC60950

SEQ ID NO: 54692 - RNA, 1410 nt, Artificial Sequence
  neuraminidase__InfluenzaA__AHC60962
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54693 - RNA, 1410 nt, Artificial Sequence; identical to SEQ ID NO: 54524
  neuraminidase__InfluenzaA__AHC60974

SEQ ID NO: 54694 - RNA, 1410 nt, Artificial Sequence; identical to SEQ ID NO: 54475
  neuraminidase__InfluenzaA__AHC60986

SEQ ID NO: 54695 - RNA, 1410 nt, Artificial Sequence; identical to SEQ ID NO: 54622
  neuraminidase__InfluenzaA__AHC60998

SEQ ID NO: 54696 - RNA, 1410 nt, Artificial Sequence; identical to SEQ ID NO: 54606
  neuraminidase__InfluenzaA__AHC61010

SEQ ID NO: 54697 - RNA, 1410 nt, Artificial Sequence
  neuraminidase__InfluenzaA__AHC61022
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcauuagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54698 - RNA, 1410 nt, Artificial Sequence; identical to SEQ ID NO: 51209
  neuraminidase__InfluenzaA__AHC61034

SEQ ID NO: 54699 - RNA, 1410 nt, Artificial Sequence
  neuraminidase__InfluenzaA__AHC61046
augaacccaaaucaaaagauaauaacgauuggcucuguuucucucaccauuuccacaauaugcuucuucaugcaaauugccaucuugauaacuacuguaacauugcauuucaagcaauacgaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaguugcagauaaauaggcaagucauaguugacagagguaauagguccgguuauucugguauuuucucuguugaaggcaagagcugcaucaaucggugcuuuuauguggaguugauuaggggaagaaaagaagaaacugaagucuuguggaccucaaacaguauuguuguguuuuguggcaccucagguacauauggaacaggcucauggccugauggggcggaccucaaucucaugccuauauaa

SEQ ID NO: 54700 - RNA, 1410 nt, Artificial Sequence; identical to SEQ ID NO: 54524
  neuraminidase__InfluenzaA__AHC61058

SEQ ID NO: 54701 - RNA, 1410 nt, Artificial Sequence; identical to SEQ ID NO: 54563
  neuraminidase__InfluenzaA__AHC61070

SEQ ID NO: 54702 - RNA, 1410 nt, Artificial Sequence
  neuraminidase__InfluenzaA__AHC61082
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaguggugcugugugaaccaacaauaauagaaagaaacaucacagaaauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauugcuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaaccccaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacuggagucuuguggaccucaaacaguauuguuguguuuuguggcaccucagguacauauggaacaggcucauggccugauggggcggaccucaaucucaugccuauauaa

SEQ ID NO: 54703 - RNA, 1410 nt, Artificial Sequence; identical to SEQ ID NO: 51209
  neuraminidase__InfluenzaA__AHC61094

SEQ ID NO: 54704 - RNA, 1410 nt, Artificial Sequence; identical to SEQ ID NO: 54511
  neuraminidase__InfluenzaA__AHC61106

SEQ ID NO: 54705 - RNA, 1410 nt, Artificial Sequence
  neuraminidase__InfluenzaA__AHC61118
augaacccaaaucaaaagauaauaacgauuggcucuguuucucucaccauuuccacaauaugcuucuucaugcaaguugccaucuugauaacuacuguaacacugcauuucaagcaauaugaauucaacucccccccaaacaaccaagugaugcugugugaaccaacaauaauagaaagaaacauaacagagauaguguaucugaccaacaccaccauagagaaggaaauaugccccaagcuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54706 - RNA, 1410 nt, Artificial Sequence; identical to SEQ ID NO: 54475
  neuraminidase__InfluenzaA__AHC61130

SEQ ID NO: 54707 - RNA, 1410 nt, Artificial Sequence; identical to SEQ ID NO: 54622
  neuraminidase__InfluenzaA__AHC61142

SEQ ID NO: 54708 - RNA, 1410 nt, Artificial Sequence; identical to SEQ ID NO: 54511
  neuraminidase__InfluenzaA__AHC61154

SEQ ID NO: 54709 - RNA, 1410 nt, Artificial Sequence
  neuraminidase__InfluenzaA__AHC61166
augaacccaaaucaaaagauaauaacgauuggcucuguuucucucaccauuuccacgauaugcuucuucaugcaaguugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagacaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54710 - RNA, 1410 nt, Artificial Sequence; identical to SEQ ID NO: 54475
  neuraminidase__InfluenzaA__AHC61178

SEQ ID NO: 54711 - RNA, 1410 nt, Artificial Sequence; identical to SEQ ID NO: 54705
  neuraminidase__InfluenzaA__AHC61190

SEQ ID NO: 54712 - RNA, 1410 nt, Artificial Sequence; identical to SEQ ID NO: 54524
  neuraminidase__InfluenzaA__AHC61202

SEQ ID NO: 54713 - RNA, 1410 nt, Artificial Sequence; identical to SEQ ID NO: 54488
  neuraminidase__InfluenzaA__AHC61214

SEQ ID NO: 54714 - RNA, 1410 nt, Artificial Sequence; identical to SEQ ID NO: 54585
  neuraminidase__InfluenzaA__AHC61226

SEQ ID NO: 54715 - RNA, 1410 nt, Artificial Sequence; identical to SEQ ID NO: 54511
  neuraminidase__InfluenzaA__AHC61238

SEQ ID NO: 54716 - RNA, 1410 nt, Artificial Sequence
  neuraminidase__InfluenzaA__AHC61250
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcagaccucaaucucaugccuauauaa

SEQ ID NO: 54717 - RNA, 1410 nt, Artificial Sequence
  neuraminidase__InfluenzaA__AHC61262
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacgagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauga

SEQ ID NO: 54718 - RNA, 1410 nt, Artificial Sequence; identical to SEQ ID NO: 54479
  neuraminidase__InfluenzaA__AHC61274

SEQ ID NO: 54719 - RNA, 1410 nt, Artificial Sequence; identical to SEQ ID NO: 51209
  neuraminidase__InfluenzaA__AHC61286

SEQ ID NO: 54720 - RNA, 1410 nt, Artificial Sequence; identical to SEQ ID NO: 54565
  neuraminidase__InfluenzaA__AHC61298

SEQ ID NO: 54721 - RNA, 1410 nt, Artificial Sequence
  neuraminidase__InfluenzaA__AHC61310
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucgaacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaauugacagagguaauagguccgguuauucugguauuuucucuguugaaggcaaaagcugcaucaaucggugcuuuuauguggaguugauuaggggaagaaaagaggaaacugaagucuuguggaccucaagcaguauuguuguguuuuguggcaccucagguacauauggaacaggcucauggccugauggggcggaccucaaucucaugccuauauaa

SEQ ID NO: 54722 - RNA, 1410 nt, Artificial Sequence; identical to SEQ ID NO: 54592
  neuraminidase__InfluenzaA__AHC61322

SEQ ID NO: 54723 - RNA, 1410 nt, Artificial Sequence
  neuraminidase__InfluenzaA__AHC61334
augaacccaaaucaaaagauaauaacgauuggcucuguuucucucaccauuuccacaauaugcuucuucaugcaaguugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugacaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggauggggagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54724 - RNA, 1410 nt, Artificial Sequence; identical to SEQ ID NO: 54488
  neuraminidase__InfluenzaA__AHC61346

SEQ ID NO: 54725 - RNA, 1410 nt, Artificial Sequence
  neuraminidase__InfluenzaA__AHC61358
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacaucuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauuaaaggcugguccaacccuaaguccaaauugcagauaaauaggcaaguuauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54726 - RNA, 1410 nt, Artificial Sequence
  neuraminidase__InfluenzaA__AHC61370
augaauccaaaucaaaagauaauaacgauuggcucuguuucucucaccauuuccacaauaugcuucuucaugcaaauugccaucuugauaacuacuguaacauugcauuucaagcaauaugaauucaacucccccccgaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcauguugaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaagguaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54727 - RNA, 1410 nt, Artificial Sequence; identical to SEQ ID NO: 54552
  neuraminidase__InfluenzaA__AHC61382

SEQ ID NO: 54728 - RNA, 1410 nt, Artificial Sequence; identical to SEQ ID NO: 54585
  neuraminidase__InfluenzaA__AHC61394

SEQ ID NO: 54729 - RNA, 1410 nt, Artificial Sequence; identical to SEQ ID NO: 54552
  neuraminidase__InfluenzaA__AHC61406

SEQ ID NO: 54730 - RNA, 1410 nt, Artificial Sequence; identical to SEQ ID NO: 54511
  neuraminidase__InfluenzaA__AHC61418

SEQ ID NO: 54731 - RNA, 1410 nt, Artificial Sequence; identical to SEQ ID NO: 54634
  neuraminidase__InfluenzaA__AHC61430

SEQ ID NO: 54732 - RNA, 1410 nt, Artificial Sequence; identical to SEQ ID NO: 54524
  neuraminidase__InfluenzaA__AHC61442

SEQ ID NO: 54733 - RNA, 1410 nt, Artificial Sequence; identical to SEQ ID NO: 54638
  neuraminidase__InfluenzaA__AHC61454

SEQ ID NO: 54734 - RNA, 1410 nt, Artificial Sequence
  neuraminidase__InfluenzaA__AHC61466
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacacaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54735 - RNA, 1410 nt, Artificial Sequence
  neuraminidase__InfluenzaA__AHC61478
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguugucucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54736 - RNA, 1410 nt, Artificial Sequence; identical to SEQ ID NO: 54597
  neuraminidase__InfluenzaA__AHC61490

SEQ ID NO: 54737 - RNA, 1410 nt, Artificial Sequence; identical to SEQ ID NO: 54475
  neuraminidase__InfluenzaA__AHC61502

SEQ ID NO: 54738 - RNA, 1410 nt, Artificial Sequence; identical to SEQ ID NO: 54524
  neuraminidase__InfluenzaA__AHC61514

SEQ ID NO: 54739 - RNA, 1410 nt, Artificial Sequence
  neuraminidase__InfluenzaA__AHC61526
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacaucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54740 - RNA, 1410 nt, Artificial Sequence
  neuraminidase__InfluenzaA__AHC61538
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguagucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54741 - RNA, 1410 nt, Artificial Sequence
  neuraminidase__InfluenzaA__AHC61550
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagauguguaugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54742 - RNA, 1410 nt, Artificial Sequence
  neuraminidase__InfluenzaA__AHC61562
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaaugauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaagcaagagcugcaucaaucggugcuuuuauguggaguugauuaggggaagaaaagaggaaacugaagucuuguggaccucaaacaguauuguuguguuuuguggcaccucagguacauauggaacaggcacauggccugauggggcggaccucaaucucaugccuauauaa

SEQ ID NO: 54743 - RNA, 1410 nt, Artificial Sequence; identical to SEQ ID NO: 54565
  neuraminidase__InfluenzaA__AHC61574

SEQ ID NO: 54744 - RNA, 1410 nt, Artificial Sequence; identical to SEQ ID NO: 54524
  neuraminidase__InfluenzaA__AHC61586

SEQ ID NO: 54745 - RNA, 1410 nt, Artificial Sequence; identical to SEQ ID NO: 54525
  neuraminidase__InfluenzaA__AHC61598

SEQ ID NO: 54746 - RNA, 1410 nt, Artificial Sequence; identical to SEQ ID NO: 54475
  neuraminidase__InfluenzaA__AHC61610

SEQ ID NO: 54747 - RNA, 1410 nt, Artificial Sequence; identical to SEQ ID NO: 54565
  neuraminidase__InfluenzaA__AHC61622

SEQ ID NO: 54748 - RNA, 1410 nt, Artificial Sequence
  neuraminidase__InfluenzaA__AHC61634
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauuaucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54749 - RNA, 1410 nt, Artificial Sequence; identical to SEQ ID NO: 51209
  neuraminidase__InfluenzaA__AHC61646

SEQ ID NO: 54750 - RNA, 1410 nt, Artificial Sequence; identical to SEQ ID NO: 54634
  neuraminidase__InfluenzaA__AHC61658

SEQ ID NO: 54751 - RNA, 1410 nt, Artificial Sequence; identical to SEQ ID NO: 54525
  neuraminidase__InfluenzaA__AHC61670

SEQ ID NO: 54752 - RNA, 1410 nt, Artificial Sequence; identical to SEQ ID NO: 54488
  neuraminidase__InfluenzaA__AHC61682

SEQ ID NO: 54753 - RNA, 1410 nt, Artificial Sequence
  neuraminidase__InfluenzaA__AHC61694
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucuggcauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54754 - RNA, 1410 nt, Artificial Sequence
  neuraminidase__InfluenzaA__AHC61706
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaacauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54755 - RNA, 1410 nt, Artificial Sequence
  neuraminidase__InfluenzaA__AHC61718
augaauccaaaucaaaagauaauaacaauuggcucuguuucucucaccauuuccacaauaugcuucuucaugcaaauugccaucuugauaacuacuguaacauuacauuucaagcaaugugaauucaacucccccccaaacaaccaagugaugcugugugaaccaacaauaauagaaagaaacauaacagagauaguguaucugaccaacaccaccauagagaaggaaauaugccccaaacuaacagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucauuuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguagaguugauuaggggaagaaaagaggaaacuggagucuuguggaccucaaacaguauuguuguguuuuguggcaccucagguacauauggaacaggcucauggccugauggggcggaccucaaucucaugccuauauaa

SEQ ID NO: 54756 - RNA, 1410 nt, Artificial Sequence; identical to SEQ ID NO: 54475
  neuraminidase__InfluenzaA__AHC61730

SEQ ID NO: 54757 - RNA, 1410 nt, Artificial Sequence; identical to SEQ ID NO: 54534
  neuraminidase__InfluenzaA__AHC61742

SEQ ID NO: 54758 - RNA, 1410 nt, Artificial Sequence
  neuraminidase__InfluenzaA__AHC61754
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucagguaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54759 - RNA, 1410 nt, Artificial Sequence; identical to SEQ ID NO: 51209
  neuraminidase__InfluenzaA__AHC61766

SEQ ID NO: 54760 - RNA, 1410 nt, Artificial Sequence; identical to SEQ ID NO: 54511
  neuraminidase__InfluenzaA__AHC61778

SEQ ID NO: 54761 - RNA, 1410 nt, Artificial Sequence; identical to SEQ ID NO: 54549
  neuraminidase__InfluenzaA__AHC61790

SEQ ID NO: 54762 - RNA, 1410 nt, Artificial Sequence; identical to SEQ ID NO: 54488
  neuraminidase__InfluenzaA__AHC61802

SEQ ID NO: 54763 - RNA, 1410 nt, Artificial Sequence; identical to SEQ ID NO: 54475
  neuraminidase__InfluenzaA__AHC61814

SEQ ID NO: 54764 - RNA, 1410 nt, Artificial Sequence
  neuraminidase__InfluenzaA__AHC61826
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaguggugcugugugaaccaacaauaauagaaagaaacaucacagagauaguguaucugaccaacaccaccauagagaaggaaauaugccccaaaccagcagaguacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaagugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54765 - RNA, 1410 nt, Artificial Sequence; identical to SEQ ID NO: 54475
  neuraminidase__InfluenzaA__AHC61838

SEQ ID NO: 54766 - RNA, 1410 nt, Artificial Sequence
  neuraminidase__InfluenzaA__AHC61850
augaacccaaaucaaaagauaauaacgauuggcucuguuucucucaccauuuccacaauaugcuucuucaugcaaguugccaucuugauaacuacuguaacacugcauuucaagcaauaugaauucaacucccccccaaacaaccaagugaugcugugugaaccaacaauaauagaaagaaacauaacagagauaguguaucugaccaacaccaccauagagaaggaaauaugccccaagcuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcgagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54767 - RNA, 1410 nt, Artificial Sequence; identical to SEQ ID NO: 54524
  neuraminidase__InfluenzaA__AHC61862

SEQ ID NO: 54768 - RNA, 1410 nt, Artificial Sequence; identical to SEQ ID NO: 54475
  neuraminidase__InfluenzaA__AHC61874

SEQ ID NO: 54769 - RNA, 1410 nt, Artificial Sequence
  neuraminidase__InfluenzaA__AHC61886
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaaguggugcugugugaaccaacaauaauagaaagaaacaucacagagauaguguaucugaccaacaccaccauagagaaggaaauaugccccaaaccagcagaauacagacauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54770 - RNA, 1410 nt, Artificial Sequence; identical to SEQ ID NO: 54479
  neuraminidase__InfluenzaA__AHC61898

SEQ ID NO: 54771 - RNA, 1410 nt, Artificial Sequence; identical to SEQ ID NO: 54511
  neuraminidase__InfluenzaA__AHC61910

SEQ ID NO: 54772 - RNA, 1410 nt, Artificial Sequence; identical to SEQ ID NO: 51209
  neuraminidase__InfluenzaA__AHC61934

SEQ ID NO: 54773 - RNA, 1410 nt, Artificial Sequence
  neuraminidase__InfluenzaA__AHC61946
augaacccaaaucaaaagauaauaacgauuggcucuguuucucucaccauuuccacaauaugcuucuucaugcaaauugccaucuugauaacuacuguaacauugcauuucaagcaauaugaauccuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccucggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgaaauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54774 - RNA, 1410 nt, Artificial Sequence; identical to SEQ ID NO: 54483
  neuraminidase__InfluenzaA__AHC61958

SEQ ID NO: 54775 - RNA, 1410 nt, Artificial Sequence; identical to SEQ ID NO: 54475
  neuraminidase__InfluenzaA__AHC61970

SEQ ID NO: 54776 - RNA, 1410 nt, Artificial Sequence
  neuraminidase__InfluenzaA__AHC61982
augaauccaaaucaaaagauaauaacgauuggcucuguuucucucaccauuuccacaauaugcuucuucaugcaaauugccaucuugauaacuacuguaacauugcauuucaagcaauaugaauucaacucccccccgaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauggcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaagguaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54777 - RNA, 1410 nt, Artificial Sequence; identical to SEQ ID NO: 54479
  neuraminidase__InfluenzaA__AHC61994

SEQ ID NO: 54778 - RNA, 1410 nt, Artificial Sequence; identical to SEQ ID NO: 54569
  neuraminidase__InfluenzaA__AHC62006

SEQ ID NO: 54779 - RNA, 1410 nt, Artificial Sequence; identical to SEQ ID NO: 54475
  neuraminidase__InfluenzaA__AHC62018

SEQ ID NO: 54780 - RNA, 1410 nt, Artificial Sequence; identical to SEQ ID NO: 54525
  neuraminidase__InfluenzaA__AHC62030

SEQ ID NO: 54781 - RNA, 1410 nt, Artificial Sequence; identical to SEQ ID NO: 54609
  neuraminidase__InfluenzaA__AHC62042

SEQ ID NO: 54782 - RNA, 1410 nt, Artificial Sequence; identical to SEQ ID NO: 54552
  neuraminidase__InfluenzaA__AHC62053

SEQ ID NO: 54783 - RNA, 1410 nt, Artificial Sequence
  neuraminidase__InfluenzaA__AHC62065
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucuguagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54784 - RNA, 1410 nt, Artificial Sequence; identical to SEQ ID NO: 54676
  neuraminidase__InfluenzaA__AHC62077

SEQ ID NO: 54785 - RNA, 1410 nt, Artificial Sequence; identical to SEQ ID NO: 54585
  neuraminidase__InfluenzaA__AHC62089

SEQ ID NO: 54786 - RNA, 1410 nt, Artificial Sequence; identical to SEQ ID NO: 54475
  neuraminidase__InfluenzaA__AHC62101

SEQ ID NO: 54787 - RNA, 1410 nt, Artificial Sequence; identical to SEQ ID NO: 54578
  neuraminidase__InfluenzaA__AHC62113

SEQ ID NO: 54788 - RNA, 1410 nt, Artificial Sequence
  neuraminidase__InfluenzaA__AHC62125
augaauccaaaucaaaagauaauaacgauugggucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauaaguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54789 - RNA, 1410 nt, Artificial Sequence
  neuraminidase__InfluenzaA__AHC62137
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaagcugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuugcaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54790 - RNA, 1410 nt, Artificial Sequence
  neuraminidase__InfluenzaA__AHC62149
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaagggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54791 - RNA, 1410 nt, Artificial Sequence; identical to SEQ ID NO: 54511
  neuraminidase__InfluenzaA__AHC62161

SEQ ID NO: 54792 - RNA, 1410 nt, Artificial Sequence
  neuraminidase__InfluenzaA__AHC62173
augaauccaaaucaaaagauaauaacaauuggcucuguuucucucaccauuuccacaauaugcuucuucaugcaaauugccaucuugauaacuacuguaacauuacauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacacugucgggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54793 - RNA, 1410 nt, Artificial Sequence; identical to SEQ ID NO: 54524
  neuraminidase__InfluenzaA__AHC62185

SEQ ID NO: 54794 - RNA, 1410 nt, Artificial Sequence; identical to SEQ ID NO: 54483
  neuraminidase__InfluenzaA__AHC62197

SEQ ID NO: 54795 - RNA, 1410 nt, Artificial Sequence
  neuraminidase__InfluenzaA__AHC62209
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaagaaucauagcauugucuccaguuauguguguucaggacuuguuggagacacacccagaaaaaacgacagcuccagcaguagccauugucuggauccuaacaaugaagaagguggucauggagugaaaggcugggccuuugaugauggaaaugacguguggaugggaagaacaaucaacgagacgucacgcuuaggguaugaaaccuucaaaguaauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54796 - RNA, 1410 nt, Artificial Sequence; identical to SEQ ID NO: 54479
  neuraminidase__InfluenzaA__AHC62221

SEQ ID NO: 54797 - RNA, 1410 nt, Artificial Sequence
  neuraminidase__InfluenzaA__AHC62233
augaauccaaaucaaaagauaauaacgauuggcucuguuucucucaccauuuccacaauaugcuucuucaugcaaauugccaucuugauaacuacuguaacauugcauuucaagcaauaugaauucaacucucccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguauguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54798 - RNA, 1410 nt, Artificial Sequence; identical to SEQ ID NO: 54475
  neuraminidase__InfluenzaA__AHC62245

SEQ ID NO: 54799 - RNA, 1410 nt, Artificial Sequence
  neuraminidase__InfluenzaA__AHC62257
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccaaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguuggcagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54800 - RNA, 1410 nt, Artificial Sequence; identical to SEQ ID NO: 54552
  neuraminidase__InfluenzaA__AHC62269

SEQ ID NO: 54801 - RNA, 1410 nt, Artificial Sequence; identical to SEQ ID NO: 54585
  neuraminidase__InfluenzaA__AHC62281

SEQ ID NO: 54802 - RNA, 1410 nt, Artificial Sequence; identical to SEQ ID NO: 54479
  neuraminidase__InfluenzaA__AHC62293

SEQ ID NO: 54803 - RNA, 1410 nt, Artificial Sequence; identical to SEQ ID NO: 54797
  neuraminidase__InfluenzaA__AHC62305

SEQ ID NO: 54804 - RNA, 1410 nt, Artificial Sequence; identical to SEQ ID NO: 54475
  neuraminidase__InfluenzaA__AHC62317

SEQ ID NO: 54805 - RNA, 1410 nt, Artificial Sequence
  neuraminidase__InfluenzaA__AHC62329
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaucacagagauaguguaucugaccaauaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaagaggggaagaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaauccaaauugcagauaaauaggcaagucauagcugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54806 - RNA, 1410 nt, Artificial Sequence; identical to SEQ ID NO: 54475
  neuraminidase__InfluenzaA__AHC62341

SEQ ID NO: 54807 - RNA, 1410 nt, Artificial Sequence
  neuraminidase__InfluenzaA__AHC62353
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaccgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54808 - RNA, 1410 nt, Artificial Sequence; identical to SEQ ID NO: 54475
  neuraminidase__InfluenzaA__AHC62365

SEQ ID NO: 54809 - RNA, 1410 nt, Artificial Sequence; identical to SEQ ID NO: 54692
  neuraminidase__InfluenzaA__AHC62377

SEQ ID NO: 54810 - RNA, 1410 nt, Artificial Sequence; identical to SEQ ID NO: 54585
  neuraminidase__InfluenzaA__AHC62389

SEQ ID NO: 54811 - RNA, 1410 nt, Artificial Sequence; identical to SEQ ID NO: 54524
  neuraminidase__InfluenzaA__AHC62401

SEQ ID NO: 54812 - RNA, 1410 nt, Artificial Sequence; identical to SEQ ID NO: 54552
  neuraminidase__InfluenzaA__AHC62413

SEQ ID NO: 54813 - RNA, 1410 nt, Artificial Sequence; identical to SEQ ID NO: 54610
  neuraminidase__InfluenzaA__AHC62425

SEQ ID NO: 54814 - RNA, 1410 nt, Artificial Sequence; identical to SEQ ID NO: 51209
  neuraminidase__InfluenzaA__AHC62437

SEQ ID NO: 54815 - RNA, 1410 nt, Artificial Sequence; identical to SEQ ID NO: 54524
  neuraminidase__InfluenzaA__AHC62449

SEQ ID NO: 54816 - RNA, 1410 nt, Artificial Sequence; identical to SEQ ID NO: 54479
  neuraminidase__InfluenzaA__AHC62461

SEQ ID NO: 54817 - RNA, 1410 nt, Artificial Sequence; identical to SEQ ID NO: 54475
  neuraminidase__InfluenzaA__AHC62473

SEQ ID NO: 54818 - RNA, 1410 nt, Artificial Sequence
  neuraminidase__InfluenzaA__AHC62485
augaauccaaaucaaaagauaauaacgauuggcucuguuucucucaccauuuccacaauaugcuucuucaugcaaauugccaucuugauaacuacuguaacauugcauuucaagcaauaugaauucaacuccccuccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacccuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54819 - RNA, 1410 nt, Artificial Sequence; identical to SEQ ID NO: 54524
  neuraminidase__InfluenzaA__AHC62509

SEQ ID NO: 54820 - RNA, 1410 nt, Artificial Sequence
  neuraminidase__InfluenzaA__AHC62521
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggagauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuauuguguuuuguggcaccucagguacauauggaacaggcucauggccugauggggcggaccucaaucucaugccuauauaa

SEQ ID NO: 54821 - RNA, 1410 nt, Artificial Sequence
  neuraminidase__InfluenzaA__AHC62533
augaacccaaaucaaaagauaauaacgauuggcucuguuucucucaccauuuccacaauaugcuucuucaugcaaguugccaucuugauaacuacuguaacauugcauuucaagcaauaugaauucaacucccccccaaacaaccaagugaugcugugugaaccaacaauaauagaaagaaacauaacagagauauuguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaaggugguaauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54822 - RNA, 1410 nt, Artificial Sequence; identical to SEQ ID NO: 54679
  neuraminidase__InfluenzaA__AHC62545

SEQ ID NO: 54823 - RNA, 1410 nt, Artificial Sequence; identical to SEQ ID NO: 54534
  neuraminidase__InfluenzaA__AHC62557

SEQ ID NO: 54824 - RNA, 1410 nt, Artificial Sequence; identical to SEQ ID NO: 54475
  neuraminidase__InfluenzaA__AHC62569

SEQ ID NO: 54825 - RNA, 1410 nt, Artificial Sequence; identical to SEQ ID NO: 54524
  neuraminidase__InfluenzaA__AHC62581

SEQ ID NO: 54826 - RNA, 1410 nt, Artificial Sequence
  neuraminidase__InfluenzaA__AHC62593
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcuggugggaacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54827 - RNA, 1410 nt, Artificial Sequence; identical to SEQ ID NO: 54597
  neuraminidase__InfluenzaA__AHC62605

SEQ ID NO: 54828 - RNA, 1410 nt, Artificial Sequence
  neuraminidase__InfluenzaA__AHC62617
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcggugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucauggucuaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54829 - RNA, 1410 nt, Artificial Sequence
  neuraminidase__InfluenzaA__AHC62629
augaauccaaaucaaaagauaauaacgauuggcucuguuucucucaccauuuccacaauaugcuucuucaugcagauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54830 - RNA, 1410 nt, Artificial Sequence
  neuraminidase__InfluenzaA__AHC62641
augaacccaaaucaaaagauaauaacgauuggcucuguuucucucaccauuuccacaguaugcuucuucaugcaaguugccaucuugauaacuacuguaacauugcauuucaagcaauaugaauucaacucccccccaaacaaccaagugaugcugugugaaccaacaauaauagaaagaaacauaacagagauauuguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54831 - RNA, 1410 nt, Artificial Sequence; identical to SEQ ID NO: 54503
  neuraminidase__InfluenzaA__AHC62653

SEQ ID NO: 54832 - RNA, 1410 nt, Artificial Sequence
  neuraminidase__InfluenzaA__AHC62665
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaggggacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagagauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54833 - RNA, 1410 nt, Artificial Sequence
  neuraminidase__InfluenzaA__AHC62677
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgaugggaaagcauggcugcauguuuguauaacgggggaugauaaaaaugcaacugcuagcuucauuuacaaugggaagcuuguagauaguguuguuucaugguccaaagaaauacucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaagguuccaauaggcccaucguagauauaaacauaaaggaucauagcauuguuuccaguuauguguguucaggacuuguuggagacacacccagaaaaaacgacaucuccagcaguagccauuguuuggauccuaacaaugaagaagguggucauggagugaaaggcugggccuuugaugauggaaaugacguguggaugggaagaacgaucaacgagacuucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54834 - RNA, 1398 nt, Artificial Sequence
  neuraminidase__InfluenzaA__AHF20560
augaauccaaaucagaagauucuaugcacuucagccacugcuaucauaauaggcgcaaucacaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaccaccaacauccaaauggaagagagaacaagcaggaauuucaauaacuuaacuaaagggcucuguacuauaaauucauggcacauauaugggaaagacaaugcaguaagaauuggagagagcucggauguuuuggucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccuggaacaauggaacuggccugauggggcuaaaauagaguacuuccucuaa

SEQ ID NO: 54835 - RNA, 1398 nt, Artificial Sequence; identical to SEQ ID NO: 53958
  neuraminidase__InfluenzaA__AHF20570

SEQ ID NO: 54836 - RNA, 1413 nt, Artificial Sequence; identical to SEQ ID NO: 47719
  neuraminidase__InfluenzaA__AHG96111

SEQ ID NO: 54837 - RNA, 1413 nt, Artificial Sequence; identical to SEQ ID NO: 47719
  neuraminidase__InfluenzaA__AHG96123

SEQ ID NO: 54838 - RNA, 1413 nt, Artificial Sequence; identical to SEQ ID NO: 47719
  neuraminidase__InfluenzaA__AHG96135

SEQ ID NO: 54839 - RNA, 1413 nt, Artificial Sequence; identical to SEQ ID NO: 47719
  neuraminidase__InfluenzaA__AHG96147

SEQ ID NO: 54840 - RNA, 1413 nt, Artificial Sequence; identical to SEQ ID NO: 47719
  neuraminidase__InfluenzaA__AHG96159

SEQ ID NO: 54841 - RNA, 1413 nt, Artificial Sequence; identical to SEQ ID NO: 47719
  neuraminidase__InfluenzaA__AHG96171

SEQ ID NO: 54842 - RNA, 1413 nt, Artificial Sequence; identical to SEQ ID NO: 47719
  neuraminidase__InfluenzaA__AHG96183

SEQ ID NO: 54843 - RNA, 1413 nt, Artificial Sequence; identical to SEQ ID NO: 47719
  neuraminidase__InfluenzaA__AHG96195

SEQ ID NO: 54844 - RNA, 1413 nt, Artificial Sequence; identical to SEQ ID NO: 47719
  neuraminidase__InfluenzaA__AHG96207

SEQ ID NO: 54845 - RNA, 1413 nt, Artificial Sequence; identical to SEQ ID NO: 47719
  neuraminidase__InfluenzaA__AHG96219

SEQ ID NO: 54846 - RNA, 1413 nt, Artificial Sequence; identical to SEQ ID NO: 47719
  neuraminidase__InfluenzaA__AHG96231

SEQ ID NO: 54847 - RNA, 1413 nt, Artificial Sequence; identical to SEQ ID NO: 47719
  neuraminidase__InfluenzaA__AHG96243

SEQ ID NO: 54848 - RNA, 1413 nt, Artificial Sequence
  neuraminidase__InfluenzaA__AHG96255
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaaucacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 54849 - RNA, 1413 nt, Artificial Sequence; identical to SEQ ID NO: 47719
  neuraminidase__InfluenzaA__AHG96267

SEQ ID NO: 54850 - RNA, 1413 nt, Artificial Sequence; identical to SEQ ID NO: 47719
  neuraminidase__InfluenzaA__AHG96279

SEQ ID NO: 54851 - RNA, 1413 nt, Artificial Sequence; identical to SEQ ID NO: 47719
  neuraminidase__InfluenzaA__AHG96291

SEQ ID NO: 54852 - RNA, 1413 nt, Artificial Sequence; identical to SEQ ID NO: 47719
  neuraminidase__InfluenzaA__AHG96303

SEQ ID NO: 54853 - RNA, 1410 nt, Artificial Sequence; identical to SEQ ID NO: 46960
  neuraminidase__InfluenzaA__AHG96362

SEQ ID NO: 54854 - RNA, 1410 nt, Artificial Sequence; identical to SEQ ID NO: 46960
  neuraminidase__InfluenzaA__AHG96374

SEQ ID NO: 54855 - RNA, 1410 nt, Artificial Sequence; identical to SEQ ID NO: 46960
  neuraminidase__InfluenzaA__AHG96386

SEQ ID NO: 54856 - RNA, 1413 nt, Artificial Sequence; identical to SEQ ID NO: 47719
  neuraminidase__InfluenzaA__AHG96398

SEQ ID NO: 54857 - RNA, 1410 nt, Artificial Sequence; identical to SEQ ID NO: 46960
  neuraminidase__InfluenzaA__AHG96410

SEQ ID NO: 54858 - RNA, 1410 nt, Artificial Sequence; identical to SEQ ID NO: 46960
  neuraminidase__InfluenzaA__AHG96422

SEQ ID NO: 54859 - RNA, 1410 nt, Artificial Sequence; identical to SEQ ID NO: 46960
  neuraminidase__InfluenzaA__AHG96434

SEQ ID NO: 54860 - RNA, 1410 nt, Artificial Sequence; identical to SEQ ID NO: 46960
  neuraminidase__InfluenzaA__AHG96446

SEQ ID NO: 54861 - RNA, 1410 nt, Artificial Sequence; identical to SEQ ID NO: 46960
  neuraminidase__InfluenzaA__AHG96458

SEQ ID NO: 54862 - RNA, 1410 nt, Artificial Sequence; identical to SEQ ID NO: 46960
  neuraminidase__InfluenzaA__AHG96470

SEQ ID NO: 54863 - RNA, 1410 nt, Artificial Sequence; identical to SEQ ID NO: 46960
  neuraminidase__InfluenzaA__AHG96482

SEQ ID NO: 54864 - RNA, 1410 nt, Artificial Sequence; identical to SEQ ID NO: 46960
  neuraminidase__InfluenzaA__AHG96494

SEQ ID NO: 54865 - RNA, 1410 nt, Artificial Sequence; identical to SEQ ID NO: 46960
  neuraminidase__InfluenzaA__AHG96506

SEQ ID NO: 54866 - RNA, 1413 nt, Artificial Sequence; identical to SEQ ID NO: 47719
  neuraminidase__InfluenzaA__AHG96518

SEQ ID NO: 54867 - RNA, 1413 nt, Artificial Sequence; identical to SEQ ID NO: 47719
  neuraminidase__InfluenzaA__AHG96530

SEQ ID NO: 54868 - RNA, 1413 nt, Artificial Sequence; identical to SEQ ID NO: 47719
  neuraminidase__InfluenzaA__AHG96542

SEQ ID NO: 54869 - RNA, 1413 nt, Artificial Sequence; identical to SEQ ID NO: 47719
  neuraminidase__InfluenzaA__AHG96554

SEQ ID NO: 54870 - RNA, 1413 nt, Artificial Sequence; identical to SEQ ID NO: 47719
  neuraminidase__InfluenzaA__AHG96566

SEQ ID NO: 54871 - RNA, 1413 nt, Artificial Sequence; identical to SEQ ID NO: 47719
  neuraminidase__InfluenzaA__AHG96578

SEQ ID NO: 54872 - RNA, 1413 nt, Artificial Sequence; identical to SEQ ID NO: 47719
  neuraminidase__InfluenzaA__AHG96590

SEQ ID NO: 54873 - RNA, 1413 nt, Artificial Sequence; identical to SEQ ID NO: 47719
  neuraminidase__InfluenzaA__AHG96602

SEQ ID NO: 54874 - RNA, 1413 nt, Artificial Sequence; identical to SEQ ID NO: 47719
  neuraminidase__InfluenzaA__AHG96614

SEQ ID NO: 54875 - RNA, 1413 nt, Artificial Sequence; identical to SEQ ID NO: 47719
  neuraminidase__InfluenzaA__AHG96626

SEQ ID NO: 54876 - RNA, 1413 nt, Artificial Sequence; identical to SEQ ID NO: 47719
  neuraminidase__InfluenzaA__AHG96638

SEQ ID NO: 54877 - RNA, 1413 nt, Artificial Sequence; identical to SEQ ID NO: 47719
  neuraminidase__InfluenzaA__AHG96650

SEQ ID NO: 54878 - RNA, 1413 nt, Artificial Sequence; identical to SEQ ID NO: 47719
  neuraminidase__InfluenzaA__AHG96662

SEQ ID NO: 54879 - RNA, 1413 nt, Artificial Sequence; identical to SEQ ID NO: 47719
  neuraminidase__InfluenzaA__AHG96674

SEQ ID NO: 54880 - RNA, 1413 nt, Artificial Sequence; identical to SEQ ID NO: 47719
  neuraminidase__InfluenzaA__AHG96686

SEQ ID NO: 54881 - RNA, 1410 nt, Artificial Sequence; identical to SEQ ID NO: 46960
  neuraminidase__InfluenzaA__AHG96698

SEQ ID NO: 54882 - RNA, 1410 nt, Artificial Sequence; identical to SEQ ID NO: 46960
  neuraminidase__InfluenzaA__AHG96710

SEQ ID NO: 54883 - RNA, 1410 nt, Artificial Sequence; identical to SEQ ID NO: 46960
  neuraminidase__InfluenzaA__AHG96722

SEQ ID NO: 54884 - RNA, 1410 nt, Artificial Sequence; identical to SEQ ID NO: 46960
  neuraminidase__InfluenzaA__AHG96734

SEQ ID NO: 54885 - RNA, 1410 nt, Artificial Sequence; identical to SEQ ID NO: 46960
  neuraminidase__InfluenzaA__AHG96746

SEQ ID NO: 54886 - RNA, 1410 nt, Artificial Sequence; identical to SEQ ID NO: 46960
  neuraminidase__InfluenzaA__AHG96758

SEQ ID NO: 54887 - RNA, 1410 nt, Artificial Sequence; identical to SEQ ID NO: 46960
  neuraminidase__InfluenzaA__AHG96770

SEQ ID NO: 54888 - RNA, 1410 nt, Artificial Sequence; identical to SEQ ID NO: 46960
  neuraminidase__InfluenzaA__AHG96782

SEQ ID NO: 54889 - RNA, 1410 nt, Artificial Sequence; identical to SEQ ID NO: 46960
  neuraminidase__InfluenzaA__AHG96794

SEQ ID NO: 54890 - RNA, 1410 nt, Artificial Sequence; identical to SEQ ID NO: 46960
  neuraminidase__InfluenzaA__AHG96806

SEQ ID NO: 54891 - RNA, 1410 nt, Artificial Sequence; identical to SEQ ID NO: 46960
  neuraminidase__InfluenzaA__AHG96818

SEQ ID NO: 54892 - RNA, 1410 nt, Artificial Sequence; identical to SEQ ID NO: 46960
  neuraminidase__InfluenzaA__AHG96830

SEQ ID NO: 54893 - RNA, 1410 nt, Artificial Sequence; identical to SEQ ID NO: 46960
  neuraminidase__InfluenzaA__AHG96842

SEQ ID NO: 54894 - RNA, 1410 nt, Artificial Sequence; identical to SEQ ID NO: 46960
  neuraminidase__InfluenzaA__AHG96854

SEQ ID NO: 54895 - RNA, 1410 nt, Artificial Sequence; identical to SEQ ID NO: 46960
  neuraminidase__InfluenzaA__AHG96866

SEQ ID NO: 54896 - RNA, 1410 nt, Artificial Sequence; identical to SEQ ID NO: 46960
  neuraminidase__InfluenzaA__AHG96878

SEQ ID NO: 54897 - RNA, 1410 nt, Artificial Sequence; identical to SEQ ID NO: 46960
  neuraminidase__InfluenzaA__AHG96890

SEQ ID NO: 54898 - RNA, 1410 nt, Artificial Sequence; identical to SEQ ID NO: 46960
  neuraminidase__InfluenzaA__AHG96902

SEQ ID NO: 54899 - RNA, 1410 nt, Artificial Sequence; identical to SEQ ID NO: 46960
  neuraminidase__InfluenzaA__AHG96914

SEQ ID NO: 54900 - RNA, 1410 nt, Artificial Sequence; identical to SEQ ID NO: 46960
  neuraminidase__InfluenzaA__AHG96926

SEQ ID NO: 54901 - RNA, 1410 nt, Artificial Sequence; identical to SEQ ID NO: 46960
  neuraminidase__InfluenzaA__AHG96938

SEQ ID NO: 54902 - RNA, 1410 nt, Artificial Sequence; identical to SEQ ID NO: 46960
  neuraminidase__InfluenzaA__AHG96950

SEQ ID NO: 54903 - RNA, 1410 nt, Artificial Sequence; identical to SEQ ID NO: 46960
  neuraminidase__InfluenzaA__AHG96962

SEQ ID NO: 54904 - RNA, 1410 nt, Artificial Sequence; identical to SEQ ID NO: 46960
  neuraminidase__InfluenzaA__AHG96974

SEQ ID NO: 54905 - RNA, 1410 nt, Artificial Sequence; identical to SEQ ID NO: 46960
  neuraminidase__InfluenzaA__AHG96986

SEQ ID NO: 54906 - RNA, 1410 nt, Artificial Sequence; identical to SEQ ID NO: 46960
  neuraminidase__InfluenzaA__AHG96998

SEQ ID NO: 54907 - RNA, 1410 nt, Artificial Sequence; identical to SEQ ID NO: 46960
  neuraminidase__InfluenzaA__AHG97010

SEQ ID NO: 54908 - RNA, 1410 nt, Artificial Sequence; identical to SEQ ID NO: 46960
  neuraminidase__InfluenzaA__AHG97022

SEQ ID NO: 54909 - RNA, 1410 nt, Artificial Sequence; identical to SEQ ID NO: 46960
  neuraminidase__InfluenzaA__AHG97034

SEQ ID NO: 54910 - RNA, 1410 nt, Artificial Sequence; identical to SEQ ID NO: 46960
  neuraminidase__InfluenzaA__AHG97046

SEQ ID NO: 54911 - RNA, 1410 nt, Artificial Sequence
  neuraminidase__InfluenzaA__AHH00872
augaauccaaaucaaaagauaauaacgauuggcucuguuucucucaccauugccacaauaugcuuccuuaugcaaauugccauccugguaacuacuguaacauugcauuucaagcaauaugaaugcaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuacgugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaauaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggggugaaaggcugggccuuugaugauggaaaugacguguggaugggaagaacgaucagcgagaagucacgcucaggauaugaaaccuucaaagucauugaaggcugguccaaaccuaacuccaaauugcagauaaauaggcaagucauaauugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggaccucaaucucaugccuauauaa

SEQ ID NO: 54912 - RNA, 1416 nt, Artificial Sequence
  neuraminidase__InfluenzaA__AHI43497
augaauccaaaucagaaacuauuugcacuauccggaguggcaauagcgcuuaguauacugaacuuauuaauagggaucucaaaugucggauugaacauuucccuacaucugaaaggaaaagggcccaaacaagaggagaauuuaacaugcacgaccauuaaucaaaacaacacuacuguaguagaaaacacauauguaaauaauacaacaauaauuacuaaggagacugacuggaauacaccaagcuaucugcuguugaacaagagccuaugcaauguugaaggcuggguagugauagcaaaagacaacgcaauaagauuuggggaaagugaacaaaucauuguuaccagggagccauauguaucaugcgacccaacaggaugcaagauguaugccuugcaccaggggaccaccauuagaaacaaacauucaaauggaacgauucaugacagaacagcuuucagaggucucaucuccacuccauugggcacuccaccgaccguaaguaacaguggcuuuauguguguuggguggucaagcacgacuugccaugaugggauuggcagaaugacuauuuguauacaaggaaauaaugacaacgccacagcaacgguuuauuauaacggaagacugaccaccaccauuaagaccugggcaagaaacauucugaggacucaagaaucagaaugugugugccacaauggcacaugcgcaguugugaugaccgacggaucggcuaguagucaagccuauacaaaaguaauguauuuccacaagggauuaguaauuaaggaagaggcauuaaggggaucagccaggcacauugaggaaugcuccuguuauggacacagucaaagagugaccuguguguguagagauaacuggcagggagcaaacaggccuauuauagagaucgacaugaacacauuggaacacacaaguagauacguaugcacuggaauccucacagacaccagcagaccuggugacaaaucuaguggugacuguuccaauccaauaacugggagucccggcgcucagggggugaagggauucggguuucuaaauggggauaacacauggcuugguagaaccaucagucccaggucaagaaguggauucgaaauguugaaaauacccaaugcagguacagaucccaauucuagaauagcagaaagacaggaaauugucgacaauaacaauuggucaggcuauucaggaagcuucauugacuauuggaauaauaacagugagugcuacaauccaugcuuuuacguagaguuaauuagaggaagacccgaagaggccaaauacguaugguggacgaguaauagucuaauugcccuauguggaagcccauucccaguuggguccgguuccuuccccgauggggcacaaauccaauacuuuucguaa

SEQ ID NO: 54913 - RNA, 1410 nt, Artificial Sequence
  neuraminidase__InfluenzaA__AHJ57439
augaauccaaaucaaaagauaauaacuauuggcucuguuucucucaucauuuccacaauaugcuucuuuaugcaaguugccaucuuguuaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaauggaaggcuuguagauaguguuguuucaugguccaaagauauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaaguuauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 54914 - RNA, 1410 nt, Artificial Sequence
  neuraminidase__InfluenzaA__AHJ57440
augaauccaaaucaaaagauaauaacuauuggcucuguuucucucaucauuuccacaauaugcuucuuuaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcucuccgcugguggggacaucugggugacaagagaaccuuaugugucaugcgauccugauaaguguuaucaauuugcccuuggacagggaacaacacuaaacaacgggcauucaaauaacacaguacgugauaggaccccuuaucggacccuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugaugggaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 54915 - RNA, 1410 nt, Artificial Sequence
  neuraminidase__InfluenzaA__AHJ57441
augaauccaaaucaaaagauaauaacuauuggcucuguuucucucaucauuuccacaauaugcuucuuuaugcaaauugccaucuugauaacuacuguaacauugcauuucaagcaauaugaauucaacucccccccaaacaaccaagugaugcugugugaaccaacaauaauagaaagaaacaaaacagagauaguguaucugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaacccuaugugucaugcgauccugacaaguguuaucaauuugcccuuggacagggaacaacacuaaacaacgugcauucaaauaacacaguacaugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 54916 - RNA, 1413 nt, Artificial Sequence
  neuraminidase__InfluenzaA__AHJ57654
augaauccaaaucaaaagauaacaugcauuucagcaacaggaaugacacuaucgguaguaagucugcuaauaggaauugccaauuugggccuaaauaucggacuccacuauaaggugagugauucaacaaauauaaacauuccaaacaugaaugagaccagcccaacaacaacaauaauaaacaaucacccucagaauaauuucacaaacaucacuaacauuauaaugaauaagaacgaggaaggaaauuuucucaaccugaccaagccgcuaugugaagucaacucauggcauauucuaucgaaagacaaugcaauaagaauaggugagaacgcucauauacuagucacaagggaaccuuacuuguccugcgacccacaaggaugcaggauguuugcucugagucaaggcacaacacucagagggcgacaugcgaauggaaccauacaugauaggagcccauuccgagcucuuauaaguugggaaaugggucaggcgcccaguccauauaaugcuagggucgagugcauaggauggucaagcacgucaugccacgauggcauaucaaggaugucaauaugcauaucaggaccgaacaacaaugcaucggcaguagugugguacggggggagaccaguaacagagaucccaucaugggcagggaacauucuuaggacucaagaaucggagugcgugugccauggagggauauguccgguggucaugacagaugguccggcaaacaauagggcagaaacuaagauaaucuauuucaaagagggaaagguacagaaaaucgaagaacugaaggggaacgcucaacacaucgaagaguguucauguuauggagcaucagggaugaucaaguguauaugcagggacaauuggaagggggcaaacagaccaguaauaacuauagauccagagaugaugacccacacaagcaaguacuuguguucaaaaaucuuaacugauacaagccgccccaaugaccccaccaaugggaacugcgaugcgccaauaacaggagggagcccagacccugggguaaaaggguuugcauuccuagacggugagaacucauggcuuggaaggacuauuagcaaagacuccagaucaggcuaugaaauguuaaaaauuccaaaugcagagaccgacacucaaucgggggcaaucucacaccagauaauugucaacaaucagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuacuuuaaguag

SEQ ID NO: 54917 - RNA, 1410 nt, Artificial Sequence
  neuraminidase__InfluenzaA__AHJ57666
augaauccaaaucaaaagauaauaacaauuggcucugucucucuaaccauugcgacaguaaguuuccucaugcagauugccauccuaacaacgacugugacacugcauuucaagcacaaugaaugcaauaugcccccgaaaaaccagguaaugucaugugaaccaauuauaauagaaaggaacauaacagagauaguguauuugaauaauacuacuguugaaaaagaaauuuguccaaaaguuguagaauacagaaauuggucgaaaccacaaugcaaaaucacaggguuugcuccuuucuccaaggacaacucaauucgacuuucugcggguggggacauuugggugacaagagaaccuuaugugucaugcggccucgguaaauguuaucaauuugcacuuggacagggaacuacauuggacaacagccauucaaauggcacaauacaugauaggaucccucaucggacucuuuuaaugaaugaguuggguguuccauuucauuugggaaccaaacaaguauguauagcaugguccagcucaaguugucaugaugggagagcaugguuacauauauguaucacaggggaugacagaaaugcgacugcuagcuucauuuaugaugggaugcucguagacagcauugguucuuggucuaaaaacauacucagaacccaggaaucugaauguguuugcaucaaugggacuugugcgguaguaaugacggauggaagugcuucaggaguugcugacacuagaauauuauucaucagagagggaaagauuguccauauaagcccauugucagggagugcucagcacauagaagaauguuccuguuauccccgauauccagacguuagauguguuugcagagacaauuggaagggcucuaauaggccaguuauagauauaaauauggcugauuauagcauugauuccaauuaugugugcucaggacuuguuggcgacacaccaagaaacgaugauaacucuagcagcagcaauugcagggacccuaauaaugagagaggaaauccaggagugaaagggugggcuuucgacgauggaaaugauguuuggaugggaaggacaaucaacagggauucacguucagguuaugagaccuucagagucauuggugguuggaccacugcuaauuccaaaucacagauaaacagacaagucauaguugacaauaacaacugguccgguuauucggguguuuucucugucgaaggcaaaagcugcaucaauagguguuuuuauguggaguuaauaaaaggaaggccgcaggaaccuagaguaugguggacuucaaacaguauuguuguauucugugguacuucagguaccuauggaacaggcucauggccugauggggcgaauaucaauuucaugccgauauaa

SEQ ID NO: 54918 - RNA, 1413 nt, Artificial Sequence
  neuraminidase__InfluenzaA__AHJ57677
augaauccaaaucaaaagauaacaugcauuucagcaacaggaaugacacuaucgguaguaaguaugcuaauaggaauugccaauuugggccuaaauaucggacuccacuauaaggugagugauucaacaaauauaaacauuccaaacaugaaugagaccagcccaacaacaacaguaauaaacaaucacccucagaauaauuucacaaacaucacuaacauuauagugaauaagaacgaggaagaaaauuuucucaaccugaccaagccgcuaugugaagucaacucauggcauauucuaucgaaagacaaugcaauaagaauaggugagaacgcucauauacuagucacaagggaaccuuacuugucaugcgauccacagggcugcaggauguuugcucugagucaaggcacaacacucagagggcaacaugcgaauggaaccauacaugacaggagcccauuccgagcucuuauaaguugggaaaugggucaggcgcccaguccauauaaugcuagggucgagugcauaggauggucaagcacgucaugccacgauggcauaucaaggaugucaauaugcauaucaggaccgaauaacaaugcaucggcaguagugugguacggggggagaccaguaacagagauccccucaugggcagggaacauucuuagaacucaagaaucggagugugugugccauggaggaauauguccaguggucaugacagaugguccggcaaacaauagggcagaaacuaaaauaaucuauuucaaagaaggaaagauacagaaagucgaagaacugaaggggaacgcucaacacaucgaagaguguucauguuauggagcaucagggaugaucaaguguauaugcagggacaauuggaaaggggcaaacagaccagugauaacuauagaucccgagaugaugacccacacaagcaaguacuuguguucaaaaaucuuaaccgauacaagccgccccaaugaccccaccaaugggaacugcgaugcgccaauaacaggagggagcccagacccugggguaaaaggguuugcauuccuagacggugagaacucauggcuuggaaggacuauuagcaaagacuccaggucaggcuaugaaauguuaaaaguuccaaaugcagagaccgacacucaaucgggggcaaucucacaccagaugauugucaacaaccagaauuggucaggguacucuggggcauucauugacuacugggcaaaaaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuacuuuaaguag

SEQ ID NO: 54919 - RNA, 1413 nt, Artificial Sequence
  neuraminidase__InfluenzaA__AHJ57689
augaauccaaaucaaaagauaacaugcauuucagcaacaggaaugacacuaucgguaguaaguaugcuaauaggaauugccaauuuaggccuaaauaucggacuccacuauaagguuagugauucaacaaauauaaacauuccaaaaaugaaugagaccagcccaacaacaacaauaauaaacaaucacccucagaauaauuucacaaacaucacuaacauuauaguuaauaaaaacgaggaagaaaauuuucucaaccugaccaagccacuaugugaagucaacucauggcauauucuaucgaaagacaaugcaauaagaauaggugagaacgcucauauacuagucacaagggaaccuuacuuguccugcgauccacagggcugcaggauguuugcucugagucaaggcacaacacucagagggcaacaugcgaauggaaccauacaugacaggagcccauuccgagcucuuauaaguugggaaaugggucaggcgcccaguccguauaaugcuagggucgagugcauaggauggucaagcacgucaugccacgauggcauaucaaggaugucaauaugcauaucaggaccgaauaacaaugcaucggcaguagugugguacggggggagaccaguaacagagauccccucaugggcagggaacauucuuaggacucaagaaucggagugugugugccauggaggaauauguccaguggucaugacagaugguccggcaaacaauagggcagaaacuaagauaaucuauuuuaaagaaggaaagauacagaaaaucgaagaacugaaggggaacgcucaacacaucgaagaguguucauguuauggagcaucagggaugaucaaguguauaugcagggacaauuggaaaggggcaaacagaccaguaauaacuauagauccugagaugaugacccacacaagcaaguacuuguguucaaaaaucuuaaccgauacaagccgccccaaugaccccaccaaugggaacugcgaugcgccaauaacaggagggaguccagacccugggguaaaaggguuugcauuccuagacggugagaacucauggcuuggaaggacuauuagcaaagacuccagaucaggcuaugaaauguuaaaaguuccaaaugcagagaccgacacucaaucgggggcaaucucacaccagauaauugucaacaaccagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugagaucaucuacuuuaaguag

SEQ ID NO: 54920 - RNA, 1413 nt, Artificial Sequence
  neuraminidase__InfluenzaA__AHJ57700
augaauccaaaucaaaagauaacaugcauuucagcaacaggaaugacacuaucgguaguaagucugcuaauaggaauugccaauuugggccuaaauaucggacuccacuauaaggugagugauucaacaaauauaaacauuccaaacaugaaugagaccaguccaacaacaacaauaauaaacaaucacccucagaauaauuucacaaauaucacuaacauuauaaugaauaagaacgaggaaggaaauuuucucaaccugaccaagccgcuaugugaagucaacucauggcauauucuaucgaaagacaaugcaauaagaauaggugagaacgcucauauacuagucacaagggaaccuuacuuguccugcgacccacaaggcugcaggauguuugcucugagucaaggcacaacacucagagggcgacaugcgaauggaaccauacaugauaggagcccauuccgagcucuuauaaguugggaaaugggucaggcgcccaguccauauaaugcuagggucgagugcauaggauggucaagcacgucaugccacgauggcauaucaaggaugucaauaugcauaucaggaccgaacaacaaugcaucggcaguagugugguacggggggagaccaguaacagagaucccaucaugggcagggaacauucuuagaacucaagaaucggagugcgugugccauggaggaauauguccgguggucaugacagaugguccggcaaacaauagggcagaaacuaagauaaucuauuucaaagagggaaagguacagaaaaucgaagaacugaaggggaaugcucaacacaucgaagaguguucauguuauggagcaucagggaugaucaaguguauaugcagggacaauuggaagggggcaaacagaccaguaauaacuauagauccagagaugaugacccacacaagcaaguacuuguguucaaaaaucuuaacugauacaagccgccccaaugaccccaccaaugggaacugcgaugcgccaauaacaggagggagcccagacccugggguaaaaggguuugcauuccuagauggugagaacucauggcuuggaaggacuauuagcaaagacuccagaucaggcuaugaaauguuaaaaguuccaaaugcagagaccgacacucaaucgggggcaaucucacaccagauaauugucaacaaucagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuacuuuaaguaa

SEQ ID NO: 54921 - RNA, 1410 nt, Artificial Sequence
  neuraminidase__InfluenzaA__AHJ57710
augaauccaaaucaaaagauaauaacaauuggcucugucucucuaaccauugcgacaguaaguuuccucaugcagauugccauccuaacaacgacugugacacugcauuucaagcacaaugaaugcaauaugcccccgaaaaaccagguaaugucaugugaaccaauuauaauagaaaggaacauaacagagauaguguauuugaauaauacuacuguugaaaaagaaauuuguccaaaaguuguagaauacagaaauuggucgaaaccacaaugcaaaaucacaggguuugcuccuuucuccaaggacaacucaauucgacuuucugcggguggggacauuugggugacaagagaaccuuaugugucaugcggccucgguaaauguuaucaauuugcacuuggacagggaacuacauuggacaacagccauucaaauggcacaauacaugauaggaucccucaucggacucuuuuaaugaaugaguuggguguuccauuucauuugggaaccaaacaaguauguauagcaugguccagcucaaguugucaugaugggagagcaugguuacauauauguaucacaggggaugacagaaaugcgacugcuagcuucauuuaugaugggaugcucguagacagcauuaguucuuggucuaaaaacauacucagaacccaggaaucugaauguguuugcaucaaugggacuugugcgguaguaaugacggauggaagugcuucaggaguugcugacacuagaauauuauucaucagagagggaaagauuguccauauaagcccauugucagggagugcucagcacauagaagaauguucuuguuauccccgauauccagacguuagauguguuugcagagacaauuggaagggcucuaauaggccaguuauaaauauaaauauggcugauuauagcauugauuccaauuaugugugcucaggacuuguuggcgacacaccaagaaacgaugauaacucuagcagcagcaauugcagggacccuaauaaugagagaggaaacccaggagugaaagggugggccuucgacgauggaaaugauguuuggaugggaaggacaaucaacagggauucacguucagguuaugagaccuucagagucauuggugguuggaccacugcuaauuccaaaucacagauaaacaggcaagucauaguugacaauaacaacugguccgguuauucggguguuuucucuguagaaggcaaaagcugcaucaauagguguuuuuauguggaguuaauaagaggaaggccgcaggaaccuagaguaugguggacuucaaacaguauuguuguauucugugguacuucagguaccuauggaacaggcucauggccugauggggcgaauaucaauuucaugccgauauaa

SEQ ID NO: 54922 - RNA, 1410 nt, Artificial Sequence
  neuraminidase__InfluenzaA__AHJ57734
augaauccaaaucaaaagauaauaacaauuggcucugucucucuaaccauugcaacaguaaguuuccucaugcagauugccauccuaacaacgacugugacacugcauuucaagcacaaugaaugcaauaugcccccgaaaaaccagguaaugucaugugaaccaauuauaauagaaaggaacauaacagagauaguguauuugaauaauacuacuguugaaaaagaaauuuguccaaaaguugcagaauacagaaauuggucgaaaccacaaugcaaaaucacaggguuugcuccuuucuccaaggacaacucaauucgacuuucugcggguggggacauuugggugacaagagaaccuuaugugucaugcggccucgguaagugcuaucaauuugcacuuggacagggaacuacauuggacaacagccauucaaauggcacaauacaugauaggaucccucaucggacucuuuuaaugaaugaguuggguguuccauuucauuugggaaccaaacaaguauguauagcaugguccagcucaaguugucaugaugggagagcaugguuacauauauguaucacaggggaugacagaaaugcgacugcuagcuucauuuaugaugggaugcucguagacagcauugguucuuggucuaaaaacauacucagaacccaggaaucugaauguguuugcaucaaugggacuugugcgguaguaaugacggauggaagugcuucaggaguugcugacacuagaauauuauucaucagagagggaaagauuguccauauaagcccauugucagggagugcucagcacauagaagaauguucuuguuauccccgauauccagacguuagauguguuugcagagacaauuggaagggcucuaauaggccaguuauaaauauaaauauggcugauuauagcauugauuccaauuaugugugcucaggacuuguuggcgacacaccaagaaacgaugauaacucuagcagcagcaauugcagggacccuaauaaugagagaggaaacccaggagugaaagggugggccuucgacgauggaaaugauguuuggaugggaaggacaaucaacagggauucacguucagguuaugagaccuucagagucauuggugguuggaccacugcuaauuccaaaucacagauaaacaggcaagucauaguugacaauaacaacugguccgguuauucggguguuuucucuguagaaggcaaaagcugcaucaauagguguuuuuauguggaguuaauaagaggaaggccgcaggaaccuagaguaugguggacuucaaacaguauuguuguauucugugguacuucagguaccuauggaacaggcucauggccugauggggccaauaucaauuucaugccgauauaa

SEQ ID NO: 54923 - RNA, 1380 nt, Artificial Sequence
  neuraminidase__InfluenzaA__AHJ57746
augaauccaaaucagaagauaauaacaauuggcucugucucuauaaccauugcagcaguauguuuccucaugcagauugccauucuggcaacgacugugacacugcacuucaagcaaaaugaaugcaacauacccucgaaaaaccauguaauuccaugugagccaaucauaauagaaaggaacauaacagagguagaaauucguccuaagguagcagaauacagagauuggucgaaaccccaaugccaaauuacagguuuugcuccuuucuccaaagacaacucaauucggcucucugcuggugggaacauuugggugacaagagaaccuuaugugucaugcggcccugauaaauguuaucaauuugcacuugggcagggaacuacauugggcaacggccauucaaauggcacaauacaugauaagaucccucaucgaacccuuuuaaugaaugaauuggguguuccauuucauuugggaaccaaacaaguaugcauagcgugguccagcucaagcugucaugaugggagagcaugguugcauguaugugucacgggggaugacaggaaugcgacagcuagcuucauuuaugaugggaugcucguugacaguauugcuucuuggucccaaaacauucucagaacucaggaaucugaaugcguuugcaucaaugggacguguacaguaguaaugacagaugggagugcuucaggaguugcugauacuagaauacuauucaucagagaaggaaaaauuguacauauaagcccguugucagggagugcccagcacauagaggaguguuccuguuauccccgccauucagacguuagguguguuugcagggacaauuggaaaggcucuaauaggccaguuguagauauaaauaugacagacuauagcauugauuccaguuaugugugcucagggcuuguuggcgacacaccaagaaaugaugauagcucuagcagcagcaauugcagggacccuaauaaugagagagggaauccaggagugaaagggugggccuuugacgauggagaugauguuuggaugggaagaacaaucaguagggauucacguucagguuaugagaccuucagagucauuggcgguuggacuacagccaauuccaaaucacagauaaauaggcaagucauaguugacaauaacaacuggucugguuauucggguguuuucucugucgaaggcaaaagcugcaucaauagguguuuuuauguggaguuaauaagaggaaggccgcaggaaacuagaguaugguggaccucaaacaguauuguuguauucugugguacuucagguaccuauggaacaggcucauggccugauggggcgaauaucaauuucaugccgauauaa

SEQ ID NO: 54924 - RNA, 1410 nt, Artificial Sequence
  neuraminidase__InfluenzaA__AHJ57758
augaauccaaaucaaaagauaauaacaguuggcucugucucucuggccauugcaacaauauguuuacuaaugcagauugccauucuggcaacgacugugacacugcacuucaagcaaaaugaaugcaauauacccucgaaaaaccagguaaugccaugugaaccaaucauaauagagaggaacauaacagagguaguauauuugaauaauacuaucauugaaaaagaaauuuguccuaaaguaguagaauacaggaauuggucgaaaccacaaugccaaaucacaggguucgcuccuuucuccaaagacaacucaauucgacuuucugcugguggggacauuuggguaacaagagaaccuuaugugucaugcagccccaguaaauguuaucaauuugcacuugggcagggaacuacauuggacaacagccauucaaauggcacaauacaugauaggaucccucaucguacccuuuugaugaaugaauuggguguuccauuucauuugggaaccaaacaaguaugcauagcaugguccagcucaagcugucaugaugggagagcaugguuacauguauguaucacgggagaugacagaaaugcgacugccagcuucauuuauaauggaaugcucguugacagcaucaguucuuggucucgaaauauccucagaacccaggaaucugaauguguuugcaucaauggaacuuguacaguaauaaugacagaugggagugcuucaggaguugcugauacuagaauacuauucaucagagaaggaaauauuguccauguaagcccauugucagggagugcucaacacauagaggaauguuccuguuauccccgauauccagacguuagauguguuugcagggacaauuggaaaggcucaaauaggccaguuguagauauaaauauggcagacuauagcauugauucccacuaugugugcucagggcuuguuggugacacgccaagaaaugaugauagcuccagcaguagcaauugcaaggauccuaacaaugagagagggaauccaggagugaaagggugggccuucgaugauggaaaugauguuuggaugggaaggacaaucagcagggauucacguucagguuaugagaccuucagggucauuggugguuggaccacugccaauuccaaaucacagauaaauaggcaagucauaguugacaauaacaacuggucugguuauucggguguuuucucuguugaaggcaagagcugcaucaauaggugcuuuuauguggaguuaauaagaggacggccgcaggaaacuagaguaugguggacuucaaacaguauugucguauucugugguacuucagguaccuauggaacaggcucauggccugauggggcgaauaucaauuucaugccgauauaa

SEQ ID NO: 54925 - RNA, 1401 nt, Artificial Sequence
  neuraminidase__InfluenzaA__AHJ57770
augaauccaaaucagaagauaauagcaauuggcucuguuucucuaaccauugcgauaauaugcuuccucaugcagauugccaucuuaacaacgacuaugacacuacauuucaagcagaaugaaugcagcaacccaucaaauaaucaaguggugccaugugaaccgaucauaauagagaggaacacagugcauuugaauaguacuaccauagagaaggaaaucuguccuaaagugguagaauacaagaauuggucaaaaccacaaugucaaauuacaggguucgcuccuuucucaaaggacaacucaauuaggcuuucugcagguggggauaucuggguaacaagagaaccuuauguuucaugcagucuuggcaaauguuaucaauuugcacuugggcagggaaccacccugaaaaacaagcacucaaauggcaccacacaugauagaauuccucacagaacucuuuuaaugaaugaauuaggugucccauuucauuugggaaccaaacaagugugcauagcauggucuagcucaagcugcuaugauggaaaagcaugguuacauauuuguguuacuggggaugauaaaaaugcuacugcuaguaucauuuaugaugggaugcuuguugacaguauugguucaugguccaaaaacauccucagaacucaggagucagaaugcguuugcaucaauggaacuugugcaguaguaaugacugauggaagugcaucaggaaaggcugacacuagaauauuauucauaagagaggggaaaauuauaaauauuagcccauugucagggagugcucagcacguugaggaaugcuccuguuacccccgguauccugaaguuagguguguuugcagagacaacuggaaggguuccaauaggcccguucuauauauaaauauggcagauuauaguguugaguccaguuaugugugcucaggacuuguuggcgacacaccaagaaaugaugauagcuccagcagcagcaacugcagagacccuaauaacgaaagaggggccccaggagugaaagggugggccuuugacgaugguaaugaugucuggaugggacgaacaaucaaaaaugauucacgcucagguuaugagacuuuuaggguagucaaugguuggaccacggcuaauucaaagucacagauaaauaggcaagucauaguugacagugaaaacuggucuggguauucugguaucuucucuguugaaggcaaaaacugcaucaacagguguuuuuauguggaguugauaagagggagaccacaggagcccagagugugguggacuucaaauagcaucauuguauucuguggaaccucagguacauauggaacaggcucauggccugauggagcgaauaucaacuucuugccuauauaa

SEQ ID NO: 54926 - RNA, 1410 nt, Artificial Sequence
  neuraminidase__InfluenzaA__AHJ57782
augaauccaaaucagaagauaauaauaauuggcucugucucucuaaccauugcaacaguaugcuuccucaugcagauugccauacuggcaacaacugugacacugcacuucaagcaaaacgaaugcaacauacccucgaaaaaccaaguagugccaugugaaccaaucauaauagaaaggaacauaacagagguaguguauuugaauaauacuaccauugaaaaagaaauuuguccugcagugguagaauacagaaauuggucgaaaccacaaugucagaucaaaggguuugcuccuuucucaaaggacaacucaauccggcuuucugcugguggggacaugugggugacaagagaaccuuaugugucaugcagucccaguaaauguuaucaauuugcacuugggcagggaacuacauuggacaacaaucauucaaauggcacaauacaugauagaaucccucaucgaacccuuuuaaugaaugaauuggguguuccauuccacuugggaaccaaacaagugugcauagccugguccagcucgagcugucaugaugggaaggcaugguugcauguguguguaacuggggaugacagaaaugcgacugcuagcuucauuuaugaugggaugcucguugacaguauugguucuuggucccaaaauauccucagaacucaagaaucugagugcguuugcaucaauggaacuuguacaguaguaaugacagaugggagugcuucaggaauugcugauacuagaauauuauuugucagagagggaaagauuguccauauaagcccauugucagggagugcucagcacauagaggaauguuccuguuauccccgcuauccagacguuagauguguuugcagggacaauuggaaaggcucuaauaggccaauuguagauaucaacauggcagacuauagcauugguuccaguuaugugugcucagggcuuguuggcgacacaccaaggaacgaugauagauuuagcagcagcaacugcagggacccuaacagcgagagagggaauccaggagugaaagggugggccuucgacgauggugaugauguuuggaugggaaggacaaucagcagggauucacguucagguuaugagacauucagaguuauuggugguuggacuacugcuaauuccaaaucacagauaaacagacaggucauaguugacaauaauaacuggucugguuauucggguguuuucucugucgaagguaagagcugcauuaauagguguuuuuauguggaguuaauaagaggaaggccacaggagacuagaguaugguggacuucaaacaguauuguaguauucugugguacuucagguaccuauggaacaggcucauggccugauggggcgaauaucaauuucaugccgauauaa

SEQ ID NO: 54927 - RNA, 1410 nt, Artificial Sequence
  neuraminidase__InfluenzaA__AHJ57794
augaauccaaaucaaaagauaauaacaguuggcucugucucucuggccauugcaacaauauguuuccuaaugcagauugccauucuggcaacgacugugacacugcacuucaagcaaaaugaaugcaauauacccucgaaaaaccagguaaugccaugugaaccaaucauaauagagaggaacauaacagagguaguauauuugaauaauacuaucauugaaaaagaaauuuguccuaaaguaguagaauacaggaauuggucgaaaccacaaugccaaaucacaggguucgcuccuuucuccaaagacaacucaauucgacuuucugcugguggggacauuuggguaacaagagaaccuuaugugucaugcagccccaguaaauguuaucaauuugcacuugggcagggaacuacauuggacaacagccauucaaauggcacaauacaugauaggaucccucaucguacccuuuugaugaaugaauuggguguuccauuucauuugggaaccaaacaaguaugcauagcaugguccagcucaagcugucaugaugggagagcaugguuacauguauguaucacgggagaugacagaaaugcgacugccagcuucauuuauaauggaaugcucguugacagcaucaguucuuggucucgaaauauccucagaacccaggaaucugaauguguuugcaucaauggaacuuguacaguaauaaugacagaugggagugcuucaggaguugcugauacuagaauacuauucaucagagaaggaaauauuguccauguaagcccauugucagggagugcucaacacauagaggaauguuccuguuauccccgauauccagacguuagauguguuugcagggacaauuggaaaggcucaaauaggccaguuguagauauaaauauggcagacuauagcauugauucccacuaugugugcucagggcuuguuggugacacgccaagaaaugaugauagcuccagcaguagcaauugcaaggauccuaacaaugagagagggaauccaggagugaaagggugggccuccgaugauggacaugauguuuggaugggaaggacaaucggcagggauucacguucagguuaugagaccuucagggucauuggcgguuggaccacugccaauuccaaaucacagauaaauaggcaagucauaguugacaauaacaacuggucugguuauucggguguuuucucuguugaaggcaagagcugcaucaauaggugcuuuuacguggaguuaauaagaggacggccgcaggaaacuagaguaugguggacuucaaacaguauugucguauucugugguacuucagguaccuauggaacaggcucauggccugauggggcgaauaucaauuucaugccgauauaa

SEQ ID NO: 54928 - RNA, 1413 nt, Artificial Sequence
  neuraminidase__InfluenzaA__AHJ57806
augaauccaaaucaaaagauaacaugcauuucagcaacaggaaugacacuaucgguaguaagucugcuaacaggaauugccaauuugggccuaaauaucggacuacacuauaaggugagugauucaacaaacauaagcauuccaaacaugaaugaggccagcccaacaacaacaauaauaaacaaucacccucagaauaauuucacaaacaucacuaacauuauaaugaauaagaacgaggaaggaaauuuucucaaccugaccaagccgcuaugugaagucaacucauggcauauucuaucgaaagacaaugcaauaagaauaggugagaacgcucauauacuagucacaagggaaccuuacuuguccugcgacccacaaggcugcaggauguuugcucugagucaaggcacaacacucagagggcgacaugcgaauggaaccauacaugauaggagcccauuccgagcucuuauaaguugggaaaugggucaggcgcccaguccauauaaugcuagggucgagugcauaggauggucaagcacgucaugccacgauggcauaucaaggaugucaauaugcauaucaggaccgaacaacaaugcaucggcaguagugugguacggggggagaccaguaacagagaucccaucaugggcagggaacauucuuaggacucaagaaucggagugcgugugccauggaggaauauguccgguggucaugacagaugguccggcgaacaauagggcagaaacuaagauaaucuauuucaaagagggaaagauacagaaaaucgaagaacugaaggggaacgcucaacacaucgaagaguguuccuguuauggagcaucagggaugaucaaguguauaugcagggacaauuggaagggggcaaacagaccaguaauaacuauagauccagagaugaugacccacacaagcaaguauuuguguucaaaaaucuuaacugauacaagccgccccaaugaccccaccaaugggaacugcgaugcgccaauaacaggagggagcccagacccugggguaaaaggguuugcauuccuugacgguaagaacucauggcuuggaaggacuauuagcaaagacuccagaucaggcuaugaaauguuaaaaguuccaaaugcagagaccgacacucaaucgggggcaaucucacaccagauaauugucaacaaucagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuacuuuaaguag

SEQ ID NO: 54929 - RNA, 1380 nt, Artificial Sequence
  neuraminidase__InfluenzaA__AHJ57818
augaauccaaaucaaaagauaacaugcauuucagcaacaggaguaacacuaucgguaguaagccugcuaauaggaaucgccaauuugggccuaaauaucggacuacacuauaaagugagcgauucaccaacuauaaacauuccaaacaugaaugagaccaacccaauaacaacaaacaucacuaacauuauagugaauaagaacgaggaaggaacauuucucaacuugaccaagccgcuaugugaagucaacucauggcacauucuaucgaaagacaaugcaauaagaauaggugaggaugcucauauacuagucacaagggaaccuuacuuguccugugauccacaaggcugcaggauguuugcucugagucaaggcacaacacucagagggcgacaugcgaauggaaccauacaugauaggagcccauuucgagcucuuauaaguugggaaaugggucaggcacccaguccauauaauacuagggucgaaugcauaggauggucaagcacgucaugccaugauggcauaucaaggaugucaauaugcauaucaggaccgaauaacaaugcaucggcaguggugugguacagggggagaccaguaacagaaauuccaucaugggcagggaacauucuuaggacucaagaaucagaaugugugugccauaaaggaaucugcccaguggucaugacagaugguccagcaaacaacaaggcagcaacuaagauaaucuauuucaaagaggggaagauacagaaaauugaagaacugcaggggaacgcucaacacaucgaagaauguucaugcuauggagcagcagggaugaucaaauguguaugcagggacaauuggaagggagcaaauagaccaauaaucacuauagaucccgaaaugaugacccacacaagcaaguacuuguguucaaaaaucuuaaccgacacaagucgucccaaugaccccaccgaugggaacugcgaugcgccaauaacaggagggagcccagacccugggguaaaaggguuugcauuccuagaaggggagaauucauggcuuggaaggacuauuagcaaagacuccaggucaggcuaugaaauguuaaaaguuccaaaugcagagaccgacacucaaucgggggcaaucucacaccagaugauugucaacaaccagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuacuuuaaguag

SEQ ID NO: 54930 - RNA, 1410 nt, Artificial Sequence
  neuraminidase__InfluenzaA__AHJ57830
augaauccaaaucaaaagauaauaacaauuggcucugucucucuaaccauugcaacaguaaguuuccucaugcagauugccauccuaacaacgacugugacacugcauuucaagcacaaugaaugcaauaugcccccgaaaaaccagguaaugucaugugaaccaauuauaauagaaaggaacauaacagagauaguguauuugaauaauacuacuauugaaaaagaaauuuguccaaaaguuguagaauacagaaauuggucgaaaccacaaugcaaaaucacaggguuugcuccuuucuccaaggacaacucaauucgacuuucugcggguggggacauuugggugacaagagaaccuuaugugucaugcggccucggcaaauguuaucaauuugcacuuggacagggaacuacauuggacaacagccauucaaauggcacaauacaugauaggaucccucaucggacucuuuuaaugaaugaguuggguguuccauuucauuugggaaccaaacaaguauguauagcaugguccagcucaagcugucaugaugggagagcaugguuacauauauguaucacaggggaugacagaaaugcgacugccaguuucauuuaugaugggaugcucguagacagcauugguucuuggucuaaaaacauacucagaacccaggaaucugaauguguuugcaucaaugggacuugugcgguaguaaugacggauggaagugcuucaggaguugcugauacuagaauacuauucaucagagagggaaagauuguccauauaagcccauugucagggagugcucagcacauagaagaauguuccuguuauccccgauauccagacguuagauguguuugcagagacaauuggaagggcucuaauaggccaguuauagauauaaauauggcugauuauagcauugauuccaauuaugugugcucaggacuuguuggcgacacaccaagaaacgaugauaacucuagcagcagcaauugcagggacccuaauaaugagagaggaaauccaggagugaaagggugggccuuugacgauggaaaugauguuuggaugggaaggacaaucaacagagauucacguucagguuaugagaccuucagagucauuggugguuggaccacugcuaauuccaaaucacagauaaacaggcaagucauaguugacaauaacaacugguccgguuauucggguguuuucucugucgaaggcaaaagcugcaucaauagguguuuuuauguggaguuaauaagaggaaggccgcaggaaccuagaguaugguggacuucaaacaguauuguuguauucugugguacuucagguaccuauggaacaggcucauggccugauggggcgaauaucaauuucaugccgauauaa

SEQ ID NO: 54931 - RNA, 1413 nt, Artificial Sequence
  neuraminidase__InfluenzaA__AHJ57842
augaauccaaaucaaaagauaacaugcauuucagcaacaggaaugacacuaucgguaguaaguaugcuaauaggaauugccaauuuaggccuaaauaucggacuccacuauaaggugagugauucaacaaauauaaacauuccaaaaaugaaugagaccaacccaacaacaacaauaauaaacaaucacccucagaauaauuucacaaacaucacuaacauuauaguuaauaaaaacgaggaagaaaauuuucucaaccugaccaagccacuaugugaagucaacucauggcauauucuaucgaaagacaaugcaauaagaauaggugagaacgcucauauacuagucacaagggaaccuuacuuguccugcgauccacagggcugcaggauguuugcucugagucaaggcacaacaaucagagggcaacaugcgaauggaaccauacaugacaggagcccauuccgagcucuuauaaguugggaaaugggucaggcgcccaguccauauaaugcuagggucgagugcauaggauggucaagcacgucaugccacgauggcauaucaaggaugucaauaugcauaucaggaccgaauaacaaugcaucggcaguagugugguacggggggagaccaguaacagagauccccucaugggcagggaacauucuuaggacucaagaaucggagugugugugccauggaggaauauguccaguggucaugacagaugguccggcaaacaauagggcagaaacuaagauaaucuauuuuaaagaaggaaagauacagaaaaucgaagaacugaaggggaacgcucaacacaucgaagaguguucauguuauggagcaucagggaugaucaaguguauaugcagggacaauuggaaaggggcaaacagaccaguaauaacuauagauccugagaugaugacccacacaagcaaguacuuguguucaaaaauuuuaaccgauacaagccgccccaaugaccccaccaaugggaacugcgaugcgccaauaacaggagggaguucagacccugggguaaaaggguuugcauuccuagacggugagaacucauggcuuggaaggacuauuagcaaagacuccaggucaggcuaugaaauguuaaaaguuccaaaugcagagaccgacacucaaucgggggcaaucucacaccagauaauugucaacaaccagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugagaucaucuacuuuaaguag

SEQ ID NO: 54932 - RNA, 1413 nt, Artificial Sequence
  neuraminidase__InfluenzaA__AHJ57853
augaauccaaaucaaaagauaacaugcauuucagcaacaggaaugacacuaucgguaguaagucugcuaauaggaauugccaauuugggccuaaaugucggacuccacuauaaggugaaugauccaacaaauauaaacauuccaaacaugaaugagaccagcccaacaacaacaauaauaaacaaucacccucagaauaauuucacaaacaucacuaacauuauagugaauaagaacgaggaagaaaauuuucucaaccugaccaagccgcuaugugaagucaacucauggcauauucuaucgaaagacaaugcaauaagaauaggugagaacgcucauauacuagucacaagggaaccuuacuuguccugcgauccacagggcugcaggauguuugcucugagucaaggcacaacacucagagggcaacaugcgaauggaaccauacaugacaggagcccauuccgagcucuuauaaguugggaaaugggucaggcgcccaguccauauaaugcuagggucgagugcauaggauggucaagcacgucaugccacgauggcauaucaaggaugucaauaugcauaucaggaccgaauaacaaugcaucggcaguggugugguacggggggagaccaguaacagagauccccucaugggcagggaacauucuuaggacucaagaaucggagugugugugccauggaggaauauguccaguggucaugacagaugguccggcaaacaauagggcagaaacuaagauaaucuauuucaaagaaggaaagauacagaaaaucgaagaacugaaggggaacgcucaacacaucgaagaguguucauguuauggagcaucagggaugaucaaguguauaugcagggacaauuggaaaggggcaaacaggccaguaauaacuauagaucccgagaugaugacccacacaagcaaguauuuguguucaaaaaucuuaaccgauacaagccgccccaaugaccccaccaaugggaacugcgaugcgccaauaacaggagggagcccagacccugggguaaaaggguuugcauuccuagacggugagaacucauggcuuggaaggacuauuagcaaagacuccagaucaggcuaugaaauguuaaaaguuccaaaugcagagaccgacacucaaucgggggcaaucucacaccagaugauugucaacaaccagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuacuuuaaguag

SEQ ID NO: 54933 - RNA, 1413 nt, Artificial Sequence
  neuraminidase__InfluenzaA__AHJ57865
augaauccaaaucaaaagauaacaugcauuucagcaacaggaaugacacuaucgguaguaaguaugcuaauaggaauugccaauuuaggccuaaauaucggacuccacuauaaggugagugauucaacaaauauaaacauuccaaaaaugaaugagaccaacccaacaacaacaauaauaaacaaucacccucagaauaauuucacaaacaucacuaacauuauaguuaauaaaaacgaggaagaaaauuuucucaaccugaccaagccacuaugugaagucaacucauggcauauucuaucgaaagacaaugcaauaagaauaggugagaacgcucauauacuagucacaagggaaccuuacuuguccugcgauccacagggcugcaggauguuugcucugagucaaggcacaacacucagagggcgacaugcgaauggaaccauacaugacaggagcccauuccgagcucuuauaaguugggaaaugggucaggcgcccaguccauauaaugcuagggucgagugcauaggauggucaagcacgucaugccacgauggcauaucaaggaugucaauaugcauaucaggaccgaauaacaaugcaucggcaguagugugguacggggggagaccaguaacagagauccccucaugggcagggaacauucuuaggacucaagaaucggagugugugugccauggaggaauauguccaguggucaugacagaugguccggcaaacaauagggcagaaacuaagauaaucuauuucaaagaaggaaagauacagaaaaucgaagaacugaaggggaacgcucaacacaucgaagaguguucauguuauggagcaucagggaugaucaaguguauaugcagggacaauuggaaaggggcaaacagaccaguaauaacuauagauccugagaugaugacccacacaagcaaguacuuguguucaaaaaucuuaaccgauacaagccgccccaaugaccccaccaaugggaacugcgaugcgccaauaacaggagggaguccagacccugggguaaaaggguuugcauuccuagacggugagaacucauggcuuggaaggacuauuagcaaagacuccagaucaggcuaugaaauguuaaaaguuccaaaugcagagaccgacacucaaucgggggcaaucucacaccagaugauugucaacaaccagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugagaucaucuacuuuaaguag

SEQ ID NO: 54934 - RNA, 1413 nt, Artificial Sequence
  neuraminidase__InfluenzaA__AHJ57876
augaauccaaaucaaaagauaacaugcauuucagcaacaggaaugacacuaucgguaguaagucugcuaauaggaauugccaauuugggccuaaauaucggacuccacuauaaggugagugauucaacaaauauaaacauuccaaacaugaaugagaccaguccaacaacaacaauaauaaacaaucacccucagaauaauuucacaaacaucacuaacauuauaaugaauaagaacgaggaaggaaauuuucucaaccugaccaagccgcuaugugaagucaacucauggcauauucuaucgaaagacaaugcaauaagaauaggugagaacgcucauauacuagucacaagggaaccuuacuuguccugcgacccacaaggcugcaggauguuugcucugagucaaggcacaacacucagagggcgacaugcaaauggaaccauacaugauaggagcccauuccgagcucuuauaaguugggaaaugggucaggcgcccaguccauauaaugcuagggucgagugcauaggauggucaagcacgucaugccacgauggaaaaucaaggaugucaauaugcauaucaggaccgaacaacaaugcaucggcaguagugugguacggggggagaccaauaacagagaucccaucaugggcagggaacauucuuagaacucaagaaucggagugcgugugccauggaggaauauguccgguggucaugacagaugguccggcaaacaauagggcagaaacuaagauaaucuauuucaaagagggaaagguacagaaaaucgaagaacugaaggggaacgcucaacacaucgaagaguguucauguuauggagcaucagggaugaucaaguguauaugcagggacaauuggaagggagcaaacagaccaguaauaacuauagauccagagaugaugacccacacaagcaaguacuuguguucaaaaaucuuaacugauacaagccgccccaaugaccccaccaaugggaacugcgaugcgccaauaacaggagggagcccagacccugggguaaaaggguuugcauuccuagacggugagaacucauggcuuggaaggacuauuagcaaagacuccagaucaggcuaugaaauguuaaaaguuccaaaugcagagaccgacacucaaucgggggcaaucucacaccagauaauugucaauaaucagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuacuuuaaguaa

SEQ ID NO: 54935 - RNA, 1413 nt, Artificial Sequence
  neuraminidase__InfluenzaA__AHJ57888
augaauccaaaucaaaagauaacaugcauuucagcaacaggaaugacacuaucgguaguaaguaugcuaauaggaauugccaauuugggccuaaauaucggacuccacuauaaggugagugauucaacaaauauaaacauuccaaacaugaaugagaccagcccaacaacaacaauaacaaacaaucacccucagaauaauuucacaaacaucacuaacauuauagugaguaagaacgaggaagaaaauuuucucaaccugaccaagccgcuaugugaagucaacucauggcauauucuaucgaaagacaaugcaauaagaauaggugagaaugcucauauacuagucacaagggaaccuuacuuguccugcgauccacagggcugcaggauguuugcucugagucaaggcacaacacucagagggcaacaugcgaauggaaccauacaugacaggagcccauuccgagcucuuauaaguugggaaaugggucaggcgcccaguccauauaaugcuagggucgagugcauaggauggucaagcacgucaugccaugauggcauaucaaggaugucaauaugcauaucaggaccgaauaacaaugcaucggcaguagugugguauggggggagaccaguaacagagauccccucaugggcagggaacauucuuaggacucaagaaucggagugugugugccauggaggaauauguccaguggucaugacagaugguccggcaaacaauagggcagaaacuaaaauaaucuauuucaaagaaggaaagauacagaaaaucgaagaacugaaggggaacgcucaacacaucgaagaguguucauguuauggagcaucagggaugaucaaguguauaugcagggacaauuggaaaggggcaaacagaccaguaauaacuauagaucccgagaugaugacccacacaagcaaguacuuguguucaaaaaucuuaaccgauacaagccgccccaaugaccccaccaaugggaacugcgaugcgccaauaacaggagggagcccagacccugggguaaaaggguuugcauuccuagacggugagaacucauggcuuggaaggacuauuagcaaagacuccaggucaggcuaugaaauguuaaaaguuccaaaugcagagaccgacacucaaucgggggcaaucucacaccagaugauugucaacaaccagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuacuuuaaguag

SEQ ID NO: 54936 - RNA, 1413 nt, Artificial Sequence
  neuraminidase__InfluenzaA__AHJ57900
augaauccaaaucaaaagauaacaugcauuucagcaacuggaaugacacuaucgguaguaagucugcuaauaggaauugccaauuugggccuaaauaucggacuccacuauaaggugagugauucaacaaauauaaacauuccaaacaugaaugagaccagcccaacagcaacaauaauaaacaaucacccucagaauaauuucacaaacaucacuaacauuauagugaauaagaacgaggaagaaaauuucuucaaccuggccaagccgcuaugugaagucaacucauggcauauucuaucgaaagacaaugcaauaagaauaggugagaacgcucauauacuagucacaagggaaccuuacuuguccugcgauccacagggcugcaggauguuugcucugagucaaggcacaacacucagagggcaacaugcgaauggaaccauacaugacaggagcccauuccgagcccuuauaaguugggaaaugggucaggcgcccaguccauauaaugcuagggucgagugcauaggauggucaagcacgucaugccacgauggcauaucaaggaugucaauaugcauaucaggaccgaauaacaaugcaucggcaguagugugguacggggggagaccaguaacagagauacccucaugggcagggaacauucuuaggacucaagaaucggagugugugugccauggaggaauauguccaguggucaugacagaugguccagcaaacaauagggcagaaacuaagauaaucuauuucaaagaaggaaagauacagaaaaucgaagaccugaaggggaacgcucaacacaucgaagaguguucauguuauggagcaucagggaugaucaaguguauaugcagggacaauuggaaaggggcaaacagaccaguaauaacuauagaucccgagaugaugacccacacaagcaaguacuuguguucaaaaaucuuaaccgauacaagccgccccaaugaccccaccaaugggaacugcgaugcgccaauaacaggagggagcccagacccugggguaaaaggguuugcauuccuagacggugagaacucauggcuuggaaggacuauuagcaaagacuccaggucaggcuaugaaauguuaaaaguuccaaaugcagagaccgacacucaaucgggggcaaucucacaccagaugauugucaacaaccagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuacuuuaaguag

SEQ ID NO: 54937 - RNA, 1413 nt, Artificial Sequence
  neuraminidase__InfluenzaA__AHJ57911
augaauccaaaucaaaagauaacaugcauuucagcaacaggagugacacuaucgguaguaagccugcuaauaggaauugccaauuugggccuaaauaucggacuccacuauaaggugagugauucaucaaauauaaacauuccaaacaugaaugagacaaacccaacaacaacuauaauaaacaaucauacucagaauaauuucaaaaacaucacuaacauuauagugaauaagaacgaggaaggaauauuucucaaccugaccaagccgcuaugugaagucaacucauggcauauucuaucgaaagacaaugcaauaagaauaggugaggaugcucauauacuagucacaagggaaccuuacuuauccugugauccgcaaggcugcaggauguuugcucugagucaaggcacaacacucagagggcgacaugcgaauggaaccauacaugauaggagcccauuccgagcucuuauaaguugggagaugggucaggcacccaguccauacaaugcuagggucgaaugcauaggauggucaagcacgucaugccacgaugguauaucaaggaugucaauauguauaucaggaccaaauaacaaugcaucagcaguggugugguacagggggagaccaguaacagaaauuccaucaugggcagggaacauccuuaggacucaagaaucggaaugugugugccauaaaggaaucugcccaguagucaugacagaugguccagcaaacaauagggcagcaacuaagauaaucuauuucaaagagggaaagauacagaaaaucgaagaacugaaagggaaugcucagcacaucgaagaauguuccugcuauggcgcagcagggaugaucaaauguauaugcagggacaauuggagaggggcaaauagaccaguaaucacuauagauccugagaugaugacccacacaagcaaguacuuguguucaaaaaucuuaacagauacaagucgccccaaugaccccaccaacgggaacugcgaugcgccaauaacaggagggagcccagacccugggguaaaaggguuugcauuccuagacggggagaacucauggcuuggaaggacaauuagcaaagacuccaggucaggcuacgaaauguuaaaagucccaaaugcagagaccgacacucaaucggggucaaccucauaccagauaauugucaacaaccaaaauuggucaggguacucaggggcauucauagacuacugggcaaacaaggaaugcuucaauccuuguuuuuauguggaacuaaucagagggagacccaaagagaguaguguacuguggacuucaaauagcauuguggcucucuguggauccagggagcgauugggaucaugguccuggcaugauggugcugaaaucaucuacuuuaaguag

SEQ ID NO: 54938 - RNA, 1410 nt, Artificial Sequence
  neuraminidase__InfluenzaA__AHJ57923
augaauccaaaucaaaagauaauaacaguuggcucugucucucuggccauugcaacaauauguuuccuaaugcagauugccauucuggcaacgacugugacacugcacuucaagcaaaaugaaugcaauauacccucgaaaaaccagguaaugccaugugaaccaaucauaauagagaggaacauaacagagguaguauauuugaauaauacuaucauugaaaaagaaauuuguccuaaaguaguagaauacaggaauuggucgaaaccacaaugccaaaucacaggguucgcuccuuucuccaaagacaacucaauucgacuuucugcugguggggacauuuggguaacaagagaaccuuaugugucaugcagccccaguaaauguuaucaauuugcacuugggcagggaacuacauuggacaacagccauucaaauggcacaauacaugauaggaucccucaucguacccuuuugaugaaugaauuggguguuccauuucauuugggaaccaaacaaguaugcauagcaugguccagcucaagcugucaugaugggagagcaugguuacauguauguaucacgggagaugacagaaaugcgacugccagcuucauuuauaauggaaugcucguugacagcaucaguucuuggucucgaaauauccucagaacccaggaaucugaauguguuugcaucaauggaacuuguacaguaauaaugacagaugggagugcuucaggaguugcugauacuagaauacuauucaucagagaaggaaagauuguccauguaagcccauugucagggagugcucaacacauagaggaauguuccuguuauccccgauauccagacguuagauguguuugcagggacaauuggaaaggcucaaauaggccaguuguagauauaaauauggcagacuauagcauugauucccacuaugugugcucagggcuuguuggugacacgccaagaaaugaugauagcuccagcaguagcaauugcaaggauccuaacaaugagagagggaauccaggagugaaagggugggccuucgaugauggaaaugauguuuggaugggaaggacaaucagcagggauucacguucagguuaugagaccuucagggucauuggugguuggaccacugccaauuccaaaucacagauaaauaggcaagucauaguugacaauaacaacuggucugguuauucggguguuuucucuguugaaggcaagagcugcaucaauaggugcuuuuacguggaguuaauaagaggacggccgcaggaaacuagaguaugguggacuucaaacaguauugucguauucugugguacuucagguaccuauggaacaggcucauggccugauggggcgaauaucaauuucaugccgauauaa

SEQ ID NO: 54939 - RNA, 1380 nt, Artificial Sequence
  neuraminidase__InfluenzaA__AHJ57935
augaauccaaaucaaaagauaacaugcauuucagcaacaggaguaacacuaucgguaguaagccugcuaauaggaaucgccaauuugggccuaaauaucggacuacacuauaaagugagugauucaccaacuauaaacauuccaaacaugaaugagaccaacccaacaacaacaaacaucacuaacauuauagugaauaagaacgaggaaggaacauuucucaacuugaccaagccgcuaugugaagucaacucauggcacauucuaucgaaagacaaugcaauaagaauaggugaggaugcucauauacuagucacaagggaaccuuacuuguccugugauccacaaggcugcaggauguuugcucugagucaaggcacaacacucagagggcgacaugcgaauggaaccauacaugauaggagcccauuucgagcucuuauaaguugggaaaugggucaggcacccaguccauauaauacuagggucgaaugcauaggauggucaagcacgucaugccaugauggcauaucaaggaugucaauaugcauaucaggaccgaauaacaaugcaucggcaguggugugguacagggggagaccaguaacagaaauuccaucaugggcagggaacauucuuaggacucaagaaucagaaugugugugccauaaaggaaucugcccaguggucaugacagaugguccagcaaacaacaaggcagcaacuaagauaaucuauuucaaagaggggaagauacagaaaauugaagaacugcaggggaacgcucaacacaucgaagaauguucaugcuauggagcagcagggaugaucaaauguguaugcagggacaauuggaagggagcaaauagaccaauaaucacuauagaucccgaaaugaugacccacacaagcaaguacuuguguucaaaaaucuuaaccgacacaagucgucccaaugaccccaccaaugggaacugcgaugcgccaauaacaggagggagcccagacccugggguaaaaggguuugcauuccuagacggggagaauucauggcuuggaaggacaauuagcaaagacuccagaucaggcuacgaaauguuaaaagucccaaaugcacagaccgacacucaaucagggccaaccucauaccagcuaauugucaacaaccaaaauuggucaggguacucaggggcauucauagacuacugggcaaacaaggaaugcuucaauccuuguuuuuauguggaacuaaucagagggagacccaaagagaguaauguacuguggacuucaaauagcaugguagcucucuguggauccagggagcgauugggaucaugguccuggcaugaugaugcagaaaucaucuacuuuaaguag

SEQ ID NO: 54940 - RNA, 1410 nt, Artificial Sequence
  neuraminidase__InfluenzaA__AHJ57946
augaauccaaaucaaaagauaauaacaauuggcucugucucucuaaccauugcaacaguaaguuuccucaugcagauugccauccuaacaacgacugugacacugcauuucaagcacaaugaaugcaauaugcccccgaaaaaccagguaaugucaugugaaccaauuauaauagaaaggaacauaacagagauaguguauuugaauaauacuacuguugaaaaagaaauuuguccaaaaguuguagaauacagaaauuggucgaaaccacaaugcaaaaucacaggguuugcuccuuucuccaaggacaacucaauucgacuuucugcggguggggacauuugggugacaagagaaccuuaugugucaugcggccucgguaaauguuaucaauuugcacuuggacagggaacuacauuggacaacagccauucaaauggcacaauacaugauaggaucccucaucggacucuuuuaaugaaugaguuggguguuccauuucauuugggaaccaaacaaguauguauagcaugguccagcucaaguugucaugaugggagagcaugguuacauauauguaucacaggggaugacagaaaugcgacugcuagcuucauuuaugaugggaugcucguagacagcauugguucuuggucuaaaaacauacucagaacccaggaaucugaauguguuugcaucaaugggacuugugcgguaguaaugacggauggaagugcuucaggaguugcugacacuagaauauuauucaucagagagggaaagauuguccauauaagcccauugucagggagugcucagcacauagaagaauguuccuguuauccccgauauccagacguuagauguguuugcagagacaauuggaagggcucuaauaggccaguuauagauauaaauauggcugauuauagcauugauucccauuaugugugcucagggcuuguuggcgacacaccaagaaacgaugauaacucuagcagcagcaauugcagggacccuaauaaugagagagggaauccaggagugaaagggugggccuucgacgauggaaaugauguuuggaugggaaggacaaucaacagggauucacguucagguuaugagaccuucagagucauuggugguuggaccacugcuaauuccaaaucacagauaaacagacaagucauaguugacaauaacaacugguccgguuauucggguguuuucucugucgaaggcaaaagcugcaucaauagguguuuuuauguggaguuaauaagaggaaggccgcaggaaccuagaguaugguggacuucaaacaguauuguuguauucugugguacuucagguaccuauggaacaggcucauggccugauggggcgaauaucaauuucaugccgauauaa

SEQ ID NO: 54941 - RNA, 1410 nt, Artificial Sequence
  neuraminidase__InfluenzaA__AHJ57957
augaauccaaaucaaaagauaauaacaauuggcucugucucucuaaccauugcgacaguaaguuuccucaugcagauugccauccuaacaacgacugugacacugcauuucaagcaaaaugaaugcaauaugcccccgaaaaaccagguaaugucaugugaaccaauuauaauagaaaggaacauaacagagauaguauauuugaauaauacuacuguugaaaaagaaauuuguccaaaaguuguagaauacagaaauuggucgaaaccacaaugcaaaaucacaggguuugcuccuuucuccaaggacaacucaauucgacuuucugcggguggggacauuugggugacaagagaaccuuaugugucaugcggccucgguaaauguuaucaauuugcacuuggacagggaacuacauuggacaacagccauucaaauggcacaauacaugauaggaucccucaucggacucuuuuaaugaaugaguuggguguuccauuucauuugggaaccaaacaaguauguauagcaugguccagcucaagcugucaugaugggagagcaugguuacauauauguaucacaggggaugacagaaaugcgacugcuagcuucauuuaugaugggaugcucguagacagcauugguucuuggucuaaaaauauacucagaacccaggaaucugaaugugucugcaucaauggaacuugugcgguaguaaugacggauggaagugcuucaggaguugcugacacuagaauauuauucaucagagagggaaagauuguccauauaagcccauugucagggagugcucagcacauagaagaauguuccuguuauccccgauauccagacguuagauguguuugcagagacaauuggaagggcucuaauaggccaguuauagauauaaauauggcugauuauagcauugauuccaauuaugugugcucaggacuuguuggcgacacaccaagaaacgaugauaacucuagcagcagcaauugcagggacccuaauaaugagagaggaaauccaggagugaaagggugggcuuucgacuauggaaaugauguuuggaugggaaggacaaucaacagggauucacguucagguuaugagaccuucagagucauuggugguuggaccacugcuaauuccaaaucacagauaaacagacaagucauaguugacaauaacaacugguccgguuauucggguguuuucucugucgaaggcaaaagcugcaucaauagguguuuuuauguggaguuaauaagaggaaggccgcaggaaccuagaguaugguggacuucaaacaguauuguuguauucugugguacuucagguaccuauggaacaggcucauggccugauggggcgaauaucaauuucaugccgauauaa

SEQ ID NO: 54942 - RNA, 1410 nt, Artificial Sequence
  neuraminidase__InfluenzaA__AHJ57968
augaauccaaaucaaaagauaauaacaguuggcucugucucucuggccauugcaacaauauguuuacuaaugcagauugccauucuggcaacgacugugacacugcacuucaagcaaaaugaaugcaauauacccucgaaaaaccagguaaugccaugugaaccaaucauaauagagaggaacauaacagagguaguauauuugaauaauacuaucauugaaaaagaaauuuguccuaaaguaguagaauacaggaauuggucgaaaccacaaugccaaaucacaggguucgcuccuuucuccaaagacaacucaauucgacuuucugcugguggggacauuuggguaacaagagaaccuuaugugucaugcagccccaguaaauguuaucaauuugcacuugggcagggaacuacauuggacaacagccauucaaauggcacaauacaugauaggaucccucaucguacccuuuugaugaaugaauuggguguuccauuucauuugggaaccaaacaaguaugcauagcaugguccagcucaagcugucaugaugggagagcaugguuacauguauguaucacgggagaugacagaaaugcgacugccagcuucauuuauaauggaaugcucguugacagcaucaguucuuggucucgaaauauccucagaacccaggaaucugaauguguuugcaucaauggaacuuguacaguaauaaugacagaugggagugcuucaggaguugcugauacuagaauacuauucaucagagagggaaagauuguccauauaagcccauugucagggagugcucagcacauagaagaauguuccuguuauccccgauauccagacguuagauguguuugcagagacaauuggaagggcucuaauaggccaguuauagauauaaauauggcugauuauagcauugauuccaauuaugugugcucaggacuuguuggcgacacaccaagaaacgaugauaacucuagcagcagcaauugcagggacccuaauaaugagagaggaaauccaggagugaaagggugggccuucgacgauggaaaugauguuuggaugggaaggacaaucaacagggauucacguucagguuaugagaccuucagggucauuggugguuggaccacugccaauuccaaaucacagauaaauaggcaagucauaguugacaauaacaacuggucugguuauucggguguuuucucuguugaaggcaagagcugcaucaauaggugcuuuuacguggaguuaauaagaggacggccgcaggaaacuagaguaugguggacuucaaacaguauugucguauucugugguacuucauguaccuauggaacaggcucauggccugauggggcgaauaucaauuucaugccgauauaa

SEQ ID NO: 54943 - RNA, 1413 nt, Artificial Sequence
  neuraminidase__InfluenzaA__AHJ57980
augaauccaaaucaaaagaauacaugcauuucagcaauaggaaugacacuaucgguaguaagccugcuaauaggaguugccgauuugggccuaaauaucggacuccacuauaaggugagugauucaucaaauauaaacauuccaaacaugaaugagaccaacccaacaacaacaauaauaaacaauaacccucagaauaauuucacaaacaucacuaacaucauagugaauaagaacgaggaagaaaaguuucucaaccugaccaagccgcuaugugaggucaacucauggcauauucuaucgaaagacaaugcaauaagaauaggugaggacgcucauauacuagucacaagggaaccuuacuuguccugcgauccacaaggcugcaggauguuugcucugagucaaggcacaacacucagagggagacaugcgaauggaaccauacaugauaggagcccauuccgagcucuuauaaguugggaaaugggucaggcgcccaguccauauaaugcuagggucgaaugcauaggauggucaagcacgucaugccacgauggcauaucaaggaugucaauaugcauaucaggaccgaauaacaaugcaucggcaguggugugguacggggggagaccaguaacagaaaucccaucaugggcagggaacauucuuaggacucaagaaucagaaugugugugccauaaaggaaucugcccaguggucaugacagauggcccagcaaacaauagggcagcaacuaagauaauuuauuucaaagagggaaagauacagaaaaucgaagaacugaaggggaacgcucaacacaucgaggaguguucguguuauggagcagcagggaugaucaaauguauaugcagggacaauuggaagggggcaaacagaccaguaaucacuauagauccugagaugaugacccacacaagcaaguacuuguguucaaaaaucuuaaccgacacaagucgccccaaugaccccaccagugggaacugcgaugcgccaauaacaggagggagcccagacccugggguaaaaggguuugcauuccuagacggugagaacucauggcuuggaaggacuauuagcaaagacuccaggucaggcuaugaaauguuaaaaguuccaaaugcagagaccgacacucaaucggggccaaucucauaccagacgauugucaacaaccagaauuggucaggguacucaggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugagaucaucuacuuuaaguag

SEQ ID NO: 54944 - RNA, 1410 nt, Artificial Sequence
  neuraminidase__InfluenzaA__AHJ57992
augaauccaaaucaaaagauaauaacaauuggcucugucucucuaaccauugcgacaguaaguuuccucaugcagauugccauccuaacaacgacugugacacugcauuucaagcacaaugaaugcaauaugcccccgaaaaaccagguaaugucaugugaaccaauuauaauagaaaggaacauaacagagauaguguauuugaauaauacuacuguugaaaaagaaauuuguccaaaaguuguagaauacagaaauuggucgaaaccacaaugcaaaaucacaggguuugcuccuuucuccaaggacaacucaauucgacuuucugcggguggggacauuugggugacaagagaaccuuaugugucaugcggccucgguaaauguuaucaauuugcacuuggacagggaacuacauuggacaacagccauucaaauggcacaauacaugauaggaucccucaucggacucuuuuaaugaaugaguuggguguuccauuucauuugggaaccaaacaaguauguauagcaugguccagcucaaguugucaugaugggagagcaugguuacauauauguaucacaggagaugacagaaaugcgacugcuagcuucauuuaugaugggaugcucguagacagcauugguucuuggucuaaaaacauacucagaacccaggaaucugaauguguuugcaucaaugggacuugugcgguaguaaugacggauggaagugcuucaggaguugcugacacuagaauauuauucaucagagagggaaagauuguccauauaagcccauugucagggagugcucagcacauagaagaauguucuuguuauccccgauauccagacguuagauguguuugcagagacaauuggaagggcucuaauaggccaguuauaaauauaaauauggcugauuauagcauugauuccaauuaugugugcucaggacuuguuggcgacacaccaagaaacgaugauaacucuagcagcagcaauugcagggacccuaauaaugagagaggaaacccaggagugaaagggugggccuucgacgauggaaaugauguuuggaugggaaggacaaucaacagggauucacguucagguuaugagaccuucagagucauuggugguuggaccacugcuaauuccaaaucacagauaaacaggcaagucauaguugacaauaacaacugguccgguuauucggguguuuucucuguagaaggcaaaagcugcaucaauagguguuuuuauguggaguuaauaagaggaaggccgcaggaaccuagaguaugguggacuucaaacaguauuguuguauucugugguacuucagguaccuauggaacaggcucauggccugauggggcgaauaucaauuucaugccgauauaa

SEQ ID NO: 54945 - RNA, 1413 nt, Artificial Sequence
  neuraminidase__InfluenzaA__AHJ58004
augaauccaaaucaaaagauaacaugcauuucagcaacaggagugacacuaucgguaguaagccugcuaauaggaauugccaauuugggccuaaauaucggacuccacuauaaggugagugauucaucaaauauaaacauuccaaacaugaaugagacaaacccaacaacaacuauaauaaacaaucauacucagaauaauuucaaaaacaucacuaacauuauaguaaauaagaacgaggaaggaacauuucucaaccugaccaagccucuaugugaagucaacucauggcauauucuaucgaaagacaaugcaauaaggauaggugaggaugcucauauacuagucacaagggaaccuuacuuguccugugauccgcaaggcugcaggauguuugcucugagucaaggcacaacacucagagggcgacaugcgaauggaaccauacaugauagaagcccauuccgagcucuuauaaguugggaaaugggucaggcacccaguccauauaaugcuaggguugaaugcauaggauggucaagcacaucaugccacgauggcauaucaaggaugucaauauguauaucaggaccaaauaacaaugcaucagcaguggugugguacagggggagaccaguaacagaaauuccaucaugggcagggaacauucuuaggacucaagaaucggaaugugugugccauaaaggaaucugcccaguagucaugacagaugguccggcaaacaauagagcagcaacuaagauaaucuauuucaaagagggaaagauacagaaaaucgaagaacugaaggggaacgcucagcacaucgaagaauguuccugcuauggagcagcagggaugaucaaauguauaugcagggacaauuggaggggggcaaauagaccaguaaucacuauagauccugagaugaugacccacacaagcaaguacuuguguucaaaaaucuuaaccgauacaagucgccccaaugaccccaccaaugggaacugcgaugagccaauaacaggagggagcccagacccugggguaaaaggguuugcauuccuagacggggagaacucauggcuuggaaggacaauuagcaaagacuccaggucaggauacgaaauguuaaaagucccaaaugcagagaccgacacucaaucggggcccaccucauaccagauaauuguaaacaaccaaaauuggucaggguacucaggggcauucauagacuacugggcaaacaaggaauguuucaauccuuguuuuuauguggaacuaaucagagggagacccaaagaaaguaguguacuguggaccucaaauagcauuguagcucucuguggauccagggagcgauugggaucaugguccuggcaugauggugcugaaaucaucuacuuuaaguag

SEQ ID NO: 54946 - RNA, 1413 nt, Artificial Sequence
  neuraminidase__InfluenzaA__AHJ58016
augaauccaaaucaaaagauaacaugcauuucagcaacaggaaugacacuaucgguaguaaguaugcuaauaggaauugccaauuuaggccuaaauaucggacuccacuauaaggugagugauucaacaaauauaaacauuccaaaaaugaaugagaccaacccaacaacaacaauaauaaacaaucacccucagaauaauuucacaaacaucacuaacauuauaguuaauaaaaacgaggaagaaaauuuucucaaccugaccaagccacuaugugaagucaacucauggcauauucuaucgaaagacaaugcaauaagaauaggugagaacgcucauauacuagucacaagggaaccuuacuuguccugcgacccacaaggcugcaggauguuugcucugagucaaggcacaacacucagagggcgacaugcgaauggaaccauacaugauaggagcccauuccgagcucuuauaaguugggaaaugggucaggcgcccaguccauauaaugcuagggucgagugcauaggauggucaagcacgucaugccacgauggcauaucaaggaugucaauaugcauaucaggaccgaacaacaaugcaucggcaguagugugguacggggggagaccaguaacagagaucccaucaugggcagggaacauucuuaggacucaagaaucggagugcgugugccauggaggaauauguccgguggucaugacagaugguccggcgaacaauagggcagaaacuaagauaaucuauuucaaagagggaaagauacagaagaucgaagaacugaaggggaacgcucaacacaucgaagaguguuccuguuauggagcaucagggaugaucaaguguauaugcagggacaauuggaagggggcaaacagaccaguaauaacuauagauccagagaugaugacccacacaagcaaguauuuguguucaaaaaucuuaacugauacaagccgccccaaugaccccaccaaugggaacugcgaugcgccaauaacaggagggagcccagacccugggguaaaaggguuugcauuccuugacgguaagaacucauggcuuggaaggacuauuagcaaagacuccagaucaggcuaugaaauguuaaaaguuccaaaugcagagaccgacacucaaucgggggcaaucucacaccagauaauugucaacaaucagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuaccuuaaguag

SEQ ID NO: 54947 - RNA, 1413 nt, Artificial Sequence
  neuraminidase__InfluenzaA__AHJ58028
augaauccaaaucaaaagauaacaugcauuucagcaacaggaaugacacuaucgguaguaaguaugcuaauaggaauugccaauuuaggccuaaauaucggacuccacuauaaggugagugauucaacaaauauaaacauuccaaaaaugaaugagaccaacccaacaacaacaauaauaaacaaucacccucagaauaauuucacaaacaucacuaacauuauaguuaauaaaaacgaggaagaaaauuuucucaaccugaccaagccacuaugugaagucaacucauggcauauucuaucgaaagacaaugcaguaaggauaggugaggaugcucauauacuagucacaagggaaccauacuuguccugugauccacaaggcugcaggauguuugcucugagucaaggcacaacgcucagagggcgacaugcgaauggaaccauacaugauagaagcccauuccgagcucuuauaagcugggaaaugggucaggcacccaguccauacaauacuaggguugaaugcauaggauggucaagcacgucgugccacgaugguauaucaaggaugucaauauguauaucaggaccaaauaacaaugcaucagcaguggugugguacagagggagaccaguaacagaaauuccaucaugggcaggaaacauucuuaggacucaagaaucggaaugugugugccauaaagggaucugcccaguagucaugacagaugguccagcaaacaauagggcagaaacuaagauaauuuauuucaaagagggaaagauacagaaaaucgaagaacuggagggaaaugcucagcacaucgaagaauguucaugcuaugguacagcagggaugaucaaauguauaugcagggacaauuggaggggagcaaauagaccaguaaucacuauagauccugagaugaugacccacacaagcagguacuuguguucaaaaaucuuaaccgauacaagucgccccaaugaccccaccaaugggaacugcgaugcgccaauaacaggagggagcccagacccuggaguaaaaggguuugcauuccuagacgggaagaacucauggcuuggaaggacaauuagcaaagacuccaggucaggcuacgaaauguuaaaagucccaaaugcagagaccgacauucaaucggggccaaccucaaaucaaauaauugucaacaaccaaaauuggucaggguacucaggggcauucauagacuacugggcaaacaaggaaugcuucaauccuuguuuuuauguggaacuaaucagagggagacccaaagaaaguaauguacuguggacuucaaauagcauuguagcucucuguggauccagggagcgauugggaucaugguccuggcaugauggugcugaaaucaucuacuuuaaguag

SEQ ID NO: 54948 - RNA, 1410 nt, Artificial Sequence
  neuraminidase__InfluenzaA__AHJ58040
augaauccaaaucaaaagauaauaacaguuggcucugucucucuggccauugcaacaauauguuuacuaaugcagauugccauucuggcaacgacugugacacugcacuucaagcaaaaugaaugcaauauacccucgaaaaaccagguaaugccaugugaaccaaucauaauagagaggaacauaacagagguaguauauuugaauaauacuaucauugaaaaagaaauuuguccuaaaguaguagaauacaggaauuggucgaaaccacaaugccaaaucacaggguucgcuccuuucuccaaagacaacucaauucgacuuucugcugguggggacauuuggguaacaagagaaccuuaugugucaugcagccccaguaaauguuaucaauuugcacuugggcagggaacuacauuggacaacagccauucaaauggcacaauacaugauaggaucccucaucguacccuuuugaugaaugaauuggguguuccauuucauuugggaaccaaacaaguaugcauagcaugguccagcucaagcugucaugaugggagagcaugguuacauguauguaucacgggagaugacaggaaugcgacugccagcuucauuuauaaugggaugcucguugacagcaucaguucuuggucucgaaauauccucagaacccaggaaucugaauguguuugcaucaauggaacuuguacaguaauaaugacagaugggagugcuucaggaguugcugauacuagaauacuauucaucagagaaggaaagauuguccauguaagcccauugucagggagugcucaacacauagaggaauguuccuguuauccccgauauccagacguuagauguguuugcagggacaauuggaaaggcucaaauaggccaguuguagauauaaauauggcagacuauagcauugauucccacuaugugugcucagggcuuguuggugacacgccaagaaaugaugauagcuccagcaguagcaauugcaaggauccuaacaaugagagagggaauccaggagugaaagggugggccuucgaugauggaaaugauguuuggaugggaaggacaaucagcagggauucacguucagguuaugagaccuucagggucauuggugguuggaccacugccaauuccaaaucacagauaaauaggcaagucauaguugacaauaacaacuggucugguuauucggguguuuucucuguugaaggcaagagcugcaucaauaggugcuuuuacguggaguuaauaagaggacggccgcaggaaacuagaguaugguggacuucaaacaguauugucguauucugugguacuucagguaccuauggaacaggcucguggccugauggggcgaauaucaauuucaugccgauauag

SEQ ID NO: 54949 - RNA, 1410 nt, Artificial Sequence
  neuraminidase__InfluenzaA__AHJ58052
augaauccaaaucaaaagauaauaacaauuggcucugucucucuaaccauugcaacaguaaguuuccucaugcagauugccauccuaacaacgacugugacacugcauuucaagcacaaugaaugcaauaugcccccgaaaaaccagguaaugucaugugaaccaauuauaauagaaaggaacauaacagagauaguguauuugaauaauacuacuguugaaaaagaaauuuguccaaaaguuguagaauacagaaauuggucgaaaccacaaugcaaaaucacaggguuugcuccuuucuccaaggacaacucaauucgacuuucugcggguggggacauuugggugacaagagaaccuuaugugucaugcggccucgguaaauguuaucaauuugcacuuggacagggaacuacauuggacaacagccauucaaauggcacaauacaugauaggaucccucaucggacucuuuuaaugaaugaguuggguguuccauuucauuugggaaccaaacaaguauguauagcaugguccagcucaaguugucaugaugggagagcaugguuacauauauguaucacaggggaugacagaaaugcgacugcuagcuucauuuaugaugggaugcucguagacagcauugguucuuggucuaaaaacauacucagaacccaggaaucugaauguguuugcaucaaugggacuugugcgguaguaaugacggauggaagugcuucaggaguugcugacacuagaauauuauucaucagagagggaaagauuguccauauaagcccauugucagggagugcucagcacauagaagaauguuccuguuauccccgauauccagacguuagauguguuugcagagacaauuggaaaggcucuaauaggccaguuauagauauaaauauggcugauuauagcauugauuccaauuaugugugcucaggacuuguuggcgacacaccaagaaacgaugauaacucuagcagcagcaauugcagggacccuaauaaugagagaggaaauccaggagugaaagggugggcuuucgacgauggaaaugauguuuggaugggaaggacaaucaacagggauucacguucagguuaugagaccuucagagucauuggugguuggaccacugcuaauuccaaaucacagauaaacagacaagucauaguugacaauaacaacugguccgguuauucggguguuuucucugucgaaggcaaaagcugcaucaauagguguuuuuauguggaguuaauaagaggaaggccgcaggaaccuagaguaugguggacuucaaacaguauuguuguauucugugguacuucagguaccuauggaacaggcucauggccugauggggcgaauaucaauuucaugccgauauaa

SEQ ID NO: 54950 - RNA, 1413 nt, Artificial Sequence
  neuraminidase__InfluenzaA__AHJ58064
augaauccaaaucaaaagauaacaugcauuucagcaacaggaaugacacuaucgguaguaagucugcuaauaggaauugccaauuugggccuaaauaucggacuccacuauaaggugagugauucaacaaauauaaacauuccaaacaugaaugagaccagcccaacaacaacaauaauaaacaaucacccucagaauaauuucacaaacaucacuaauauuauagugaauaagaacgaggaagaaaauuuucucaaucugaccaagccgcuaugugaagucaacucauggcauauucuaucgaaagacaaugcaauaagaauaggugagaacgcucauauacuagucacaagggaaccuuacuuguccugcgauccacagggcugcaggauguuugcucugagucaaggcacaacacucagagggcaacaugcgaauggaaccauacaugacaggagcccauuccgagcucuuauaaguugggaaaugggucaggcgcccaguccauauaaugcuagggucgagugcauaggauggucaagcacgucaugccacgauggcauaucaaggaugucaauaugcauaucaggaccaaauaacaaugcaucggcaguagugugguacggggggagaccaguaacagagauccccucaugggcagggaacauucuuaggacucaagaaucggagugugugugccauggaggaauauguccaguggucaugacagaugguccggcaaacaauagggcagaaacuaagauaaucuauuucaaagaaggaaaaauacagaaaaucgaagaacugaaggggaacgcucaacacaucgaagaguguucauguuauggagcaucagggaugaucaaguguauaugcagggacaauuggaaaggggcaaacagaccaguaauaacuauagaucccgagaugaugacccacacaagcaaguacuuguguucaaaaaucuuaaccgauacaagccgccccaaugaccccaucaaugggaacugcgaugcgccaauaacaggagggagcccagacccugggguaaaaggauuugcauuccuagacggugagaacucauggcuuggaaggacuauuagcaaagacuccaggucaggcuaugaaauguuaaaaguuccaaaugcagagaccgacacucaaucgggggcaaucucacaccagaugauugucaacaaccagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuacuuuaaguag

SEQ ID NO: 54951 - RNA, 1401 nt, Artificial Sequence
  neuraminidase__InfluenzaA__AHJ58075
augaauccaaaucagaagauaauagcaauuggcucuguuucucuaaccauugcgauaauauguuuucuccugcagauugccaucuuaacaacgaccaugacacuacauuucaggcagaaugaaugcagcaauccaucgaauaaucaaguggugccaugugaaccuaucauaauagagaggaacacagugcauuugaauaguacuaccauagagaaggaaauuuguccuaaaguggcagaauacaagaauuggucaaaaccacaaugucaaauaacaggguuugcuccuuucucaaaggacaacucaauuaggcuuucugcagguggagauaucugggugacaagagaaccuuaugugucgugcagucuuggaaaauguuaucaguuugcacuugggcagggaaccacucugaaaaacaagcacucaaauggcacuacacaugauagaauuccucacagaacucuuuuaaugaaugaguuaggugucccauuucauuugggaaccaaacaagugugcauagcauggucuaguucaagcugccaugaugggaaagcaugguuacauauuugugugacuggggaugauaaaaaugcuacugcuaguaucauuuaugaugggaugcugguugacaguauugguucaugguccaaaaacauccuaagaacccaggagucagaaugcguuugcaucaauggaacuugugcaguaguaaugacugauggaagugcaucaggaaaggcugacacuagaauauuauucauaagagagggaaaaauuauaaauauuagcccauugucaggaagugcucagcacguggaggaaugcuccuguuacccccgguauccugaaguuagguguguuugcagagacaauuggaagggcuccaauaggcccguucuauauauaaauauggcagauuauaguauugaguccaguuauguaugcucaggacuuguuggcgacacaccaagagaugaugauagcuccaguagcagcaacuguagagacccuaauaacgaaagaggggccccaggaguaaaagggugggccuuugacgaugggaaugacauuuggaugggacgaacaaucaaaagugauucacgcucagguuaugagacuuuuagggucguuaaugguuggaccacagcuaauuccaagucacagauaaauaggcaagucauaguugacagugacagcuggucuggguauucugguaucuucucuguugaaggcaaaaacugcaucaacagguguuuuuauguggaguugauaagagggagaccacaggagaccagagugugguggacuucaaacagcaucauuguauucuguggaaccucagguacauauggaacaggcucauggccugauggagcgaauaucaacuucaugccuauauaa

SEQ ID NO: 54952 - RNA, 1413 nt, Artificial Sequence
  neuraminidase__InfluenzaA__AHJ58087
augaauccaaaucaaaagauaacaugcauuucagcaacaggaaugacacuaucgguaguaagucugcuaauaggaauugccaauuugggccuaaauaucggacuccacuauaaggugagugauucaacaaauauaaacauuccaaacaugaaugagaccagcccaacaacaacaauaauaaacaaucacccucagaauaauuucacaaacaucacuaauauuauagugaauaagaacgaggaagaaaauuuucucaaucugaccaagccgcuaugugaagucaacucauggcauauucuaucgaaagacaaugcaauaagaauaggugagaacgcucauauacuagucacaagggaaccuuacuuguccugcgauccacagggcugcaggauguuugcucugagucaaggcacaacacucagagggcaacaugcgaauggaaccauacaugacaggagcccauuccgagcucuuauaaguugggaaaugggucaggcgcccaguccauauaaugcuagggucgagugcauaggauggucaagcacgucaugccacgauggcauaucaaggaugucaauaugcauaucaggaccaaauaacaaugcaucggcaguagugugguacggggggagaccaguaacagagauccccucaugggcagggaacauucuuaggacucaagaaucggagugugugugccauggaggaauauguccaguggucaugacagaugguccggcaaacaauagggcagaaacuaagauaaucuauuucaaagaaggaaaaauacagaaaaucgaagaacugaaggggaacgcucaacacaucgaagaguguucauguuauggagcaucagggaugaucaaguguauaugcagggacaauuggaaaggggcaaacagaccaguaauaacuauagaucccgagaugaugacccacacaagcaaguacuuguguucaaaaaucuuaaccgauacaagccgccccaaugaccccaucaaugggaacugcgaugcgccaauaacaggagggagcccagacccugggguaaaaggguuugcauuccuagacggugauaacucauggcuuggaaggacuauuagcaaagacuccaggucaggcuaugaaauguuaaaaguuccaaaugcagagaccgacacucaaucgggggcaaucucacaccagaugauugucaacaaccagaauuggucaggguacucuggggcauucauugacuacugggcaaacaaggaaugcuucaauccuuguuuuuauguggaacuaaucagagggagacccaaagagaguaguguacuguggacuucaaauagcauuguagcucucuguggauccagggagcgauugggaucaugguccuggcaugauggugcugaaaucaucuacuuuaaguag

SEQ ID NO: 54953 - RNA, 1410 nt, Artificial Sequence
  neuraminidase__InfluenzaA__AHL80721
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagaugucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54954 - RNA, 1410 nt, Artificial Sequence
  neuraminidase__InfluenzaA__AHL80732
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuaccuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagauacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaucauugacaaguaa

SEQ ID NO: 54955 - RNA, 1410 nt, Artificial Sequence; identical to SEQ ID NO: 47242
  neuraminidase__InfluenzaA__AHL80743

SEQ ID NO: 54956 - RNA, 1410 nt, Artificial Sequence
  neuraminidase__InfluenzaA__AHL80754
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaauguguauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54957 - RNA, 1410 nt, Artificial Sequence; identical to SEQ ID NO: 47242
  neuraminidase__InfluenzaA__AHL80765

SEQ ID NO: 54958 - RNA, 1410 nt, Artificial Sequence
  neuraminidase__InfluenzaA__AHL80776
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuuccuucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 54959 - RNA, 1410 nt, Artificial Sequence; identical to SEQ ID NO: 54958
  neuraminidase__InfluenzaA__AHL80787

SEQ ID NO: 54960 - RNA, 1410 nt, Artificial Sequence
  neuraminidase__InfluenzaA__AHL80798
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaaccaaaagcauuaguucaagaaacgguuuugagaugauuugggauccgaacggauggacugggacagacaauaacuucucaguaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54961 - RNA, 1410 nt, Artificial Sequence
  neuraminidase__InfluenzaA__AHL80809
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccguacaacucaagauuugagucagucgccuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 54962 - RNA, 1410 nt, Artificial Sequence; identical to SEQ ID NO: 54961
  neuraminidase__InfluenzaA__AHL80820

SEQ ID NO: 54963 - RNA, 1410 nt, Artificial Sequence; identical to SEQ ID NO: 49104
  neuraminidase__InfluenzaA__AHL80831

SEQ ID NO: 54964 - RNA, 1410 nt, Artificial Sequence
  neuraminidase__InfluenzaA__AHL80842
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuuccuucaaauacggcaaugguguuuggauagggagaacuaaaagcauuaguucaagaaaugguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagaggacgacccaaagagaacacaaucuggacuagugggagcagcauauccuuuugugguguaaacagugacacuguggguuggucuuggccagacggugcugaguugccauuuaccauugacaaguaa

SEQ ID NO: 54965 - RNA, 1410 nt, Artificial Sequence; identical to SEQ ID NO: 48530
  neuraminidase__InfluenzaA__AHL80853

SEQ ID NO: 54966 - RNA, 1410 nt, Artificial Sequence
  neuraminidase__InfluenzaA__AHL80864
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54967 - RNA, 1410 nt, Artificial Sequence; identical to SEQ ID NO: 48530
  neuraminidase__InfluenzaA__AHL80875

SEQ ID NO: 54968 - RNA, 1410 nt, Artificial Sequence
  neuraminidase__InfluenzaA__AHL80886
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuucugugguguaaacagugacacuguggguuggucuuggccagauggugcugaguugccauuuaccauugacaaguaa

SEQ ID NO: 54969 - RNA, 1410 nt, Artificial Sequence
  neuraminidase__InfluenzaA__AHL80897
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguauaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaaccaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54970 - RNA, 1410 nt, Artificial Sequence
  neuraminidase__InfluenzaA__AHL80908
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucacuauucaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaacaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54971 - RNA, 1410 nt, Artificial Sequence
  neuraminidase__InfluenzaA__AHL80919
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuacuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54972 - RNA, 1410 nt, Artificial Sequence
  neuraminidase__InfluenzaA__AHL80930
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccuuaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54973 - RNA, 1410 nt, Artificial Sequence; identical to SEQ ID NO: 54972
  neuraminidase__InfluenzaA__AHL80949

SEQ ID NO: 54974 - RNA, 1410 nt, Artificial Sequence
  neuraminidase__InfluenzaA__AHL80961
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagaugucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54975 - RNA, 1410 nt, Artificial Sequence; identical to SEQ ID NO: 54974
  neuraminidase__InfluenzaA__AHL80972

SEQ ID NO: 54976 - RNA, 1410 nt, Artificial Sequence; identical to SEQ ID NO: 54972
  neuraminidase__InfluenzaA__AHL80983

SEQ ID NO: 54977 - RNA, 1410 nt, Artificial Sequence; identical to SEQ ID NO: 54972
  neuraminidase__InfluenzaA__AHL80992

SEQ ID NO: 54978 - RNA, 1410 nt, Artificial Sequence; identical to SEQ ID NO: 54972
  neuraminidase__InfluenzaA__AHL81004

SEQ ID NO: 54979 - RNA, 1410 nt, Artificial Sequence
  neuraminidase__InfluenzaA__AHL81016
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauucugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54980 - RNA, 1410 nt, Artificial Sequence; identical to SEQ ID NO: 54972
  neuraminidase__InfluenzaA__AHL81028

SEQ ID NO: 54981 - RNA, 1410 nt, Artificial Sequence
  neuraminidase__InfluenzaA__AHL81040
augaauccaaaucaaaagauaauaacgauuggcucuguuucucucaccauuuccacaauaugcuucuucaugcaaauugccaucuugauaacuacuguaacauugcauuucaagcaauaugaauucaacucucccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauagcguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacagcauuguuguguuuuguggcaccucagguacauauggaacaggcucauggccugauggggcggaccucaaucucaugccuauauaa

SEQ ID NO: 54982 - RNA, 1410 nt, Artificial Sequence; identical to SEQ ID NO: 54981
  neuraminidase__InfluenzaA__AHL81052

SEQ ID NO: 54983 - RNA, 1410 nt, Artificial Sequence; identical to SEQ ID NO: 54974
  neuraminidase__InfluenzaA__AHL81064

SEQ ID NO: 54984 - RNA, 1410 nt, Artificial Sequence; identical to SEQ ID NO: 54974
  neuraminidase__InfluenzaA__AHL81075

SEQ ID NO: 54985 - RNA, 1410 nt, Artificial Sequence
  neuraminidase__InfluenzaA__AHL81086
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuguguaaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuagacuuuccgcugguggggacaucugggugacaagagaaccuuaugugucaugcgauccugacaaguguuaucaauuugcccuuggacaggggacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54986 - RNA, 1410 nt, Artificial Sequence
  neuraminidase__InfluenzaA__AHL81098
augaauccaaaucaaaagauaauaacgauuggcucuguuucucucaccauuuccacaauaugcuucuucgugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaagcugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaaugagacgucacguuuaggguaugaaaccuucaaagucauugaaggcugguccaacccuaaguccaaauugcagauaaauaggcaagucauaguugacagagggaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 54987 - RNA, 1410 nt, Artificial Sequence
  neuraminidase__InfluenzaA__AHL81110
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 54988 - RNA, 1410 nt, Artificial Sequence; identical to SEQ ID NO: 54987
  neuraminidase__InfluenzaA__AHL81121

SEQ ID NO: 54989 - RNA, 1410 nt, Artificial Sequence; identical to SEQ ID NO: 54981
  neuraminidase__InfluenzaA__AHL81132

SEQ ID NO: 54990 - RNA, 1410 nt, Artificial Sequence; identical to SEQ ID NO: 54981
  neuraminidase__InfluenzaA__AHL81144

SEQ ID NO: 54991 - RNA, 1410 nt, Artificial Sequence; identical to SEQ ID NO: 52297
  neuraminidase__InfluenzaA__AHL81156

SEQ ID NO: 54992 - RNA, 1410 nt, Artificial Sequence
  neuraminidase__InfluenzaA__AHL81168
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagaaauaguguaucugaccaacaccaccauagagaaggaaauaugccccaaacuagcagaauacagaaauuggucaaaaccgcaaugugacauuacaggauuugcacccuuuucuaaggacaauucgaucaggcuuuccgcugguggagacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcugaccucaaucucaugccuauauaa

SEQ ID NO: 54993 - RNA, 1410 nt, Artificial Sequence; identical to SEQ ID NO: 54992
  neuraminidase__InfluenzaA__AHL81180

SEQ ID NO: 54994 - RNA, 1410 nt, Artificial Sequence; identical to SEQ ID NO: 54972
  neuraminidase__InfluenzaA__AHL81192

SEQ ID NO: 54995 - RNA, 1410 nt, Artificial Sequence
  neuraminidase__InfluenzaA__AHL81215
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaauguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggauaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaauuucaugccuauauaa

SEQ ID NO: 54996 - RNA, 1410 nt, Artificial Sequence
  neuraminidase__InfluenzaA__AHL81227
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuacuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaggagaacacaaucuggacuagcgggagcagcauauccuuuugugguguaaacagugacacuguggguuggucuuggccagacggugcugaguugccauuuaccauugacaaguaa

SEQ ID NO: 54997 - RNA, 1410 nt, Artificial Sequence; identical to SEQ ID NO: 54981
  neuraminidase__InfluenzaA__AHL81238

SEQ ID NO: 54998 - RNA, 1410 nt, Artificial Sequence; identical to SEQ ID NO: 54981
  neuraminidase__InfluenzaA__AHL81250

SEQ ID NO: 54999 - RNA, 1410 nt, Artificial Sequence; identical to SEQ ID NO: 54981
  neuraminidase__InfluenzaA__AHL81262

SEQ ID NO: 55000 - RNA, 1410 nt, Artificial Sequence; identical to SEQ ID NO: 54981
  neuraminidase__InfluenzaA__AHL81274

SEQ ID NO: 55001 - RNA, 1410 nt, Artificial Sequence; identical to SEQ ID NO: 54981
  neuraminidase__InfluenzaA__AHL81286

SEQ ID NO: 55002 - RNA, 1410 nt, Artificial Sequence; identical to SEQ ID NO: 54981
  neuraminidase__InfluenzaA__AHL81298

SEQ ID NO: 55003 - RNA, 1410 nt, Artificial Sequence; identical to SEQ ID NO: 54974
  neuraminidase__InfluenzaA__AHL81310

SEQ ID NO: 55004 - RNA, 1410 nt, Artificial Sequence
  neuraminidase__InfluenzaA__AHL81332
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55005 - RNA, 1410 nt, Artificial Sequence
  neuraminidase__InfluenzaA__AHL81343
augaauccaaaucaaaagauaauaacgauuggcucuguuucucuuaccauuuccacaauaugcuuccucaugcaaauugccaucuugauaacuacuguaacauugcauuucaagcaauaugaauucaacucccccccaaacaaccaagugaugcugugugaaccaacaauaauagaaagaaacauaacagagauaguguaccugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaauuacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguucggacccuaacaaugaggaagguggucauggggugaaaggcugggccuuugaugauggaaaugacguguggaugggaagaacgaucagcgagaagucacgcuuaggauaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 55006 - RNA, 1410 nt, Artificial Sequence; identical to SEQ ID NO: 54981
  neuraminidase__InfluenzaA__AHL81355

SEQ ID NO: 55007 - RNA, 1410 nt, Artificial Sequence
  neuraminidase__InfluenzaA__AHL81367
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaauucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55008 - RNA, 1410 nt, Artificial Sequence; identical to SEQ ID NO: 54987
  neuraminidase__InfluenzaA__AHL81378

SEQ ID NO: 55009 - RNA, 1410 nt, Artificial Sequence; identical to SEQ ID NO: 54987
  neuraminidase__InfluenzaA__AHL81389

SEQ ID NO: 55010 - RNA, 1410 nt, Artificial Sequence; identical to SEQ ID NO: 54981
  neuraminidase__InfluenzaA__AHL81400

SEQ ID NO: 55011 - RNA, 1410 nt, Artificial Sequence; identical to SEQ ID NO: 54995
  neuraminidase__InfluenzaA__AHL81412

SEQ ID NO: 55012 - RNA, 1410 nt, Artificial Sequence; identical to SEQ ID NO: 54958
  neuraminidase__InfluenzaA__AHL81422

SEQ ID NO: 55013 - RNA, 1410 nt, Artificial Sequence; identical to SEQ ID NO: 54968
  neuraminidase__InfluenzaA__AHL81433

SEQ ID NO: 55014 - RNA, 1410 nt, Artificial Sequence
  neuraminidase__InfluenzaA__AHL88954
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauuaaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagauaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 55015 - RNA, 1410 nt, Artificial Sequence
  neuraminidase__InfluenzaA__AHL89033
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaagacaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 55016 - RNA, 1410 nt, Artificial Sequence
  neuraminidase__InfluenzaA__AHL89045
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgacauccuggugucagaugugucugcagagacaacuggaagggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55017 - RNA, 1410 nt, Artificial Sequence
  neuraminidase__InfluenzaA__AHL89057
augaauccaaaucaaaagauaauaacgauuggcucuguuucucucaccauuuccacaauaugcuucuucaugcaaauugccaucuugauaacuacuguaacacugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucuauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaaaccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcacuucagguacauauggaacaggcucauggccugauggggcggacaucaaucucaugccuauauaa

SEQ ID NO: 55018 - RNA, 1410 nt, Artificial Sequence
  neuraminidase__InfluenzaA__AHL89069
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaaaauuauagcauuguuucaaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 55019 - RNA, 1410 nt, Artificial Sequence
  neuraminidase__InfluenzaA__AHL89081
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguauuaauggaacuuguacaguaguaaugacugaugggagugcuucaggaaaagcugauacuaaaauacuauucauugaggaggggaaaaucguucauacuagcacauugucagggagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauuacagauaaauaggcaagucauaguugacagagguaauagguccgguuauucugguaucuucucuguugaaggcaaaagcugcaucaaucggugcuuuuauguggaguugauaaggggaagaaaagaggaaacugaagucuuguggaccucaaacaguauuguuguguuuuguggcacuucagguacauauggaacaggcucauggccugauggggcggacaucaaucucaugccuauauaa

SEQ ID NO: 55020 - RNA, 1410 nt, Artificial Sequence
  neuraminidase__InfluenzaA__AHL89093
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaagguaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 55021 - RNA, 1410 nt, Artificial Sequence
  neuraminidase__InfluenzaA__AHL89117
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcagauaucaaucucaugccuauauaa

SEQ ID NO: 55022 - RNA, 1410 nt, Artificial Sequence
  neuraminidase__InfluenzaA__AHL89129
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 55023 - RNA, 1410 nt, Artificial Sequence
  neuraminidase__InfluenzaA__AHL89141
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugauaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55024 - RNA, 1410 nt, Artificial Sequence
  neuraminidase__InfluenzaA__AHL89153
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuuucccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgaaaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 55025 - RNA, 1410 nt, Artificial Sequence
  neuraminidase__InfluenzaA__AHL89165
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuugcaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55026 - RNA, 1410 nt, Artificial Sequence
  neuraminidase__InfluenzaA__AHL89177
augaauccaaaucaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaugaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaaucgguccgguuauucugguauuuucucuguugaaggcaaaagcugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaucuuaugccuauauaa

SEQ ID NO: 55027 - RNA, 1410 nt, Artificial Sequence; identical to SEQ ID NO: 51206
  neuraminidase__InfluenzaA__AHL89189

SEQ ID NO: 55028 - RNA, 1410 nt, Artificial Sequence
  neuraminidase__InfluenzaA__AHL89201
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaauggaaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 55029 - RNA, 1410 nt, Artificial Sequence
  neuraminidase__InfluenzaA__AHL89213
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuacgugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55030 - RNA, 1410 nt, Artificial Sequence
  neuraminidase__InfluenzaA__AHL89225
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugauaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacaaucagcgagaaguuacgcuuaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55031 - RNA, 1410 nt, Artificial Sequence; identical to SEQ ID NO: 51206
  neuraminidase__InfluenzaA__AHL89237

SEQ ID NO: 55032 - RNA, 1410 nt, Artificial Sequence; identical to SEQ ID NO: 46211
  neuraminidase__InfluenzaA__AHL89261

SEQ ID NO: 55033 - RNA, 1410 nt, Artificial Sequence
  neuraminidase__InfluenzaA__AHL89273
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugauaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugacgucuuguggaccucaaacaguauuguuguguuuuguggcaccucagguacauauggaacaggcucauggccugauggggcggacaucaaucucaugccuauauaa

SEQ ID NO: 55034 - RNA, 1410 nt, Artificial Sequence
  neuraminidase__InfluenzaA__AHL89285
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugauaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaagaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugacgucuuguggaccucaaacaguauuguuguguuuuguagcaccucagguacauauggaacaggcucauggccugauggggcggacaucaaucucaugccuauauaa

SEQ ID NO: 55035 - RNA, 1410 nt, Artificial Sequence; identical to SEQ ID NO: 55033
  neuraminidase__InfluenzaA__AHL89297

SEQ ID NO: 55036 - RNA, 1410 nt, Artificial Sequence; identical to SEQ ID NO: 55033
  neuraminidase__InfluenzaA__AHL89309

SEQ ID NO: 55037 - RNA, 1410 nt, Artificial Sequence
  neuraminidase__InfluenzaA__AHL89321
augaauccaaaucaaaagauaauaacgauuggcucuguuucucucaccauuuccacaauaugcuucuucaugcaaauugccaucuugauaacuacuguaacauugcauuucaagcaauaugaauucaacucccccccgaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugauggaagugcuucaggaaaagcugauacuaaaauacuauucauugaggaggggaaaaucguucauauuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauacggaacaggcucauggccugauggggcggacaucaaucucaugccuauauaa

SEQ ID NO: 55038 - RNA, 1410 nt, Artificial Sequence
  neuraminidase__InfluenzaA__AHL89333
augaauccaaaucaaaagauaauaacgauuggcucuguuucucucaccauuuccacaauaugcuucuucaugcaaauugccaucuugauagcuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugauaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55039 - RNA, 1410 nt, Artificial Sequence
  neuraminidase__InfluenzaA__AHL89345
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaaguuauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 55040 - RNA, 1410 nt, Artificial Sequence; identical to SEQ ID NO: 46210
  neuraminidase__InfluenzaA__AHL89357

SEQ ID NO: 55041 - RNA, 1410 nt, Artificial Sequence
  neuraminidase__InfluenzaA__AHL89369
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucaauuagacuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaauggaaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 55042 - RNA, 1410 nt, Artificial Sequence
  neuraminidase__InfluenzaA__AHL89381
augaauccaaaucaaaagauaauaacgauuggcucuguuucucucaccauuuccacaauaugcuucuucaugcaaauugccaucuugauaacuacuguaacauugcauuucaagcaauaugaauacaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugauaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugccacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55043 - RNA, 1410 nt, Artificial Sequence; identical to SEQ ID NO: 55033
  neuraminidase__InfluenzaA__AHL89405

SEQ ID NO: 55044 - RNA, 1410 nt, Artificial Sequence
  neuraminidase__InfluenzaA__AHL89417
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauagacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuugggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 55045 - RNA, 1410 nt, Artificial Sequence; identical to SEQ ID NO: 47076
  neuraminidase__InfluenzaA__AHL89429

SEQ ID NO: 55046 - RNA, 1410 nt, Artificial Sequence
  neuraminidase__InfluenzaA__AHL89441
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaguguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaaacaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaagaggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55047 - RNA, 1410 nt, Artificial Sequence; identical to SEQ ID NO: 55046
  neuraminidase__InfluenzaA__AHL89453

SEQ ID NO: 55048 - RNA, 1410 nt, Artificial Sequence
  neuraminidase__InfluenzaA__AHL89465
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaucaccauagagaaggaaaaaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugauagguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcuccggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgccuaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55049 - RNA, 1410 nt, Artificial Sequence
  neuraminidase__InfluenzaA__AHL89477
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugauaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55050 - RNA, 1410 nt, Artificial Sequence
  neuraminidase__InfluenzaA__AHL89489
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguagcauuacaggauuugcaccuuuuucuaaggacaauucgauuaggcuuuccgcugguggggacaucugggugacaagagaaccuuaugugucaugcgauccugacaagugcuaucaauuugcccuuggacagggaacaacacuaaacaacgugcauucaaaugacacaguacaugauagaaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagacauaaacauaaaggauuauagcauuguuuccaguuaugugugcucaggacuuguuggagacacacccagaaaaaacgacagauccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccucauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguucuguggcaccucagguacauauggaacaggcucauggccugauggggcggacaucaaucucaugccuauauaa

SEQ ID NO: 55051 - RNA, 1410 nt, Artificial Sequence; identical to SEQ ID NO: 47076
  neuraminidase__InfluenzaA__AHL89501

SEQ ID NO: 55052 - RNA, 1410 nt, Artificial Sequence; identical to SEQ ID NO: 47076
  neuraminidase__InfluenzaA__AHL89513

SEQ ID NO: 55053 - RNA, 1410 nt, Artificial Sequence; identical to SEQ ID NO: 47076
  neuraminidase__InfluenzaA__AHL89525

SEQ ID NO: 55054 - RNA, 1410 nt, Artificial Sequence
  neuraminidase__InfluenzaA__AHL89537
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccguaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaauggaaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 55055 - RNA, 1413 nt, Artificial Sequence
  neuraminidase__InfluenzaA__AHL89549
augaauccaaaucaaaaaauaauaaccauugggucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggcccuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcggauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaacacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 55056 - RNA, 1413 nt, Artificial Sequence
  neuraminidase__InfluenzaA__AHL89561
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagccccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgccccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 55057 - RNA, 1413 nt, Artificial Sequence
  neuraminidase__InfluenzaA__AHL89573
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacaggaauaugcaaccaaagaaucaucacauaugaaaacagcaccugggugaaucacacauauguuaguauuaacaacacuaauguuguugcuggaaaggacaaaacuucagugacauuggccgguaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 55058 - RNA, 1413 nt, Artificial Sequence
  neuraminidase__InfluenzaA__AHL89585
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugagucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 55059 - RNA, 1413 nt, Artificial Sequence
  neuraminidase__InfluenzaA__AHL89597
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuagggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaccaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccauucaccauugacaaauag

SEQ ID NO: 55060 - RNA, 1413 nt, Artificial Sequence; identical to SEQ ID NO: 55058
  neuraminidase__InfluenzaA__AHL89609

SEQ ID NO: 55061 - RNA, 1413 nt, Artificial Sequence
  neuraminidase__InfluenzaA__AHL89621
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagccccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacauagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 55062 - RNA, 1413 nt, Artificial Sequence; identical to SEQ ID NO: 46720
  neuraminidase__InfluenzaA__AHL89633

SEQ ID NO: 55063 - RNA, 1413 nt, Artificial Sequence
  neuraminidase__InfluenzaA__AHL89645
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggcgaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 55064 - RNA, 1413 nt, Artificial Sequence
  neuraminidase__InfluenzaA__AHL89657
augaauccaaaucaaaaaauaauaaccauuggaucaaucaguauagcaauagggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 55065 - RNA, 1413 nt, Artificial Sequence
  neuraminidase__InfluenzaA__AHL89669
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggcgaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacgaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 55066 - RNA, 1413 nt, Artificial Sequence
  neuraminidase__InfluenzaA__AHL89681
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugacugauggcccgaguaauggggccgccucguacaaaaucuucaagaucgaaaaggggaagauuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaaccgauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaauag

SEQ ID NO: 55067 - RNA, 1413 nt, Artificial Sequence
  neuraminidase__InfluenzaA__AHL89693
augaacccaaaucaaaagauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacguauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaaaggaauaauaacuggaaccauaaaaaguuggagaaagcaaauauuaagaacacaagagucugaaugugucuguaugaacgggucauguuucaccauaaugaccgauggcccgaguaauggggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugaugaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagaggacugccuagagaaaauacaacaaucuggacuagugggagcagcauuucuuucuguggcguuaauagugauacugcaaacuggucuuggccagacggugcugaguugccguucaccauugacaaguag

SEQ ID NO: 55068 - RNA, 1413 nt, Artificial Sequence
  neuraminidase__InfluenzaA__AHL89705
augaauccaaaucaaaaaauaauaaccauuggaucaaucaguauagcaauagggauaauuagucuaauguugcaaauaggaaauauuauuucaauaugggcuagucacucaauccaaaauggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 55069 - RNA, 1413 nt, Artificial Sequence; identical to SEQ ID NO: 46535
  neuraminidase__InfluenzaA__AHL89717

SEQ ID NO: 55070 - RNA, 1413 nt, Artificial Sequence; identical to SEQ ID NO: 46662
  neuraminidase__InfluenzaA__AHL89729

SEQ ID NO: 55071 - RNA, 1413 nt, Artificial Sequence
  neuraminidase__InfluenzaA__AHL89753
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaugacaaaacuucagugacauuggcgggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucaggggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 55072 - RNA, 1413 nt, Artificial Sequence
  neuraminidase__InfluenzaA__AHL89765
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacaccaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaauguaggaccuuuuuucugacccaaggugcucuauuaaaugacaaacauucaaauggaaccguuaaggaccgaaguccuuauagggcccuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 55073 - RNA, 1413 nt, Artificial Sequence; identical to SEQ ID NO: 46687
  neuraminidase__InfluenzaA__AHL89777

SEQ ID NO: 55074 - RNA, 1413 nt, Artificial Sequence; identical to SEQ ID NO: 46540
  neuraminidase__InfluenzaA__AHL89789

SEQ ID NO: 55075 - RNA, 1413 nt, Artificial Sequence
  neuraminidase__InfluenzaA__AHL89801
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucaguggcauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucuuguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 55076 - RNA, 1413 nt, Artificial Sequence
  neuraminidase__InfluenzaA__AHL89813
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacugcugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaaccgauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaauag

SEQ ID NO: 55077 - RNA, 1413 nt, Artificial Sequence
  neuraminidase__InfluenzaA__AHL89825
augaauccaaaucaaaaaauaauaaccauuggaucaaucaguauagcaaucggaauaauuagucuaauguugcaaauaggaaacauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccuuacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucuuguuucaccauaaugaccgauggcccaaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggauuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 55078 - RNA, 1413 nt, Artificial Sequence; identical to SEQ ID NO: 55064
  neuraminidase__InfluenzaA__AHL89837

SEQ ID NO: 55079 - RNA, 1413 nt, Artificial Sequence
  neuraminidase__InfluenzaA__AHL89849
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuuauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagagccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucuuguuucaccauaaugaccgauggcccgaguaauggggccgccucguacaaaaucuucaagaucgaaaagggaaugguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacaggcuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 55080 - RNA, 1410 nt, Artificial Sequence; identical to SEQ ID NO: 46582
  neuraminidase__InfluenzaA__AHL89861

SEQ ID NO: 55081 - RNA, 1410 nt, Artificial Sequence
  neuraminidase__InfluenzaA__AHL89873
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacggagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55082 - RNA, 1410 nt, Artificial Sequence
  neuraminidase__InfluenzaA__AHL89885
augaauccaaaucaaaagauaauaacgauuggcucuguuucucucaccauuuccacaauaugcuucuucaugcaaauugccaucuuaauaacuacuguaacauugcauuucaagcaauacgaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaauauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggagaggcuccaauaggcccauaguagauauaaacaugaaggauuauagcauuguuuccaguuaugugugcucaggacuuguuggagacacacccagaaaaaacgacagcuccagcaguggccauugcuuggauccuaacaaugaagaagguggucauggagugaaaggcugggccuuugaugaugggaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55083 - RNA, 1410 nt, Artificial Sequence
  neuraminidase__InfluenzaA__AHL89897
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagauguguaugcagagacaacuggaaaggcuccaauaggcccaucguagacauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55084 - RNA, 1410 nt, Artificial Sequence
  neuraminidase__InfluenzaA__AHL89909
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaauaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucgguguuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 55085 - RNA, 1410 nt, Artificial Sequence
  neuraminidase__InfluenzaA__AHL89921
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55086 - RNA, 1410 nt, Artificial Sequence
  neuraminidase__InfluenzaA__AHL89933
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaacaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 55087 - RNA, 1410 nt, Artificial Sequence
  neuraminidase__InfluenzaA__AHL89945
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaacucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55088 - RNA, 1410 nt, Artificial Sequence
  neuraminidase__InfluenzaA__AHL89957
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguauuguuucaugguccaaagaaauccucaggacccaggagucagaaugcguuuguaucaauggaacuuguacaguaguaaugacugaugggagugcuucaggaaaagcugauacuaaaauacuauucauuaaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcacuucagguacauauggaacaggcucauggccugauggggcggacaucaaucucaugccuauauaa

SEQ ID NO: 55089 - RNA, 1410 nt, Artificial Sequence
  neuraminidase__InfluenzaA__AHL89969
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggauggucuaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55090 - RNA, 1410 nt, Artificial Sequence; identical to SEQ ID NO: 55089
  neuraminidase__InfluenzaA__AHL89981

SEQ ID NO: 55091 - RNA, 1410 nt, Artificial Sequence
  neuraminidase__InfluenzaA__AHL89993
augaauccaaaucaaaagauaauaacgauuggcucuguuucucucuccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacacuaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauagacccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55092 - RNA, 1410 nt, Artificial Sequence
  neuraminidase__InfluenzaA__AHL90005
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauaaaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauauuauucauugaggaggggaaaauuguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuacagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaacaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 55093 - RNA, 1410 nt, Artificial Sequence
  neuraminidase__InfluenzaA__AHL90017
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaccggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55094 - RNA, 1410 nt, Artificial Sequence
  neuraminidase__InfluenzaA__AHL90029
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaagaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacguugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaacugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55095 - RNA, 1410 nt, Artificial Sequence
  neuraminidase__InfluenzaA__AHL90041
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauaggaccgguuauucugguauuuucucuguugaaggcaaaagcugcaucaaucggugcuuuuauguggaauugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55096 - RNA, 1410 nt, Artificial Sequence; identical to SEQ ID NO: 46561
  neuraminidase__InfluenzaA__AHL90053

SEQ ID NO: 55097 - RNA, 1410 nt, Artificial Sequence
  neuraminidase__InfluenzaA__AHL90065
augaauccaaaucaaaagauaauaacgauuggcucuguuucucucacaauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55098 - RNA, 1410 nt, Artificial Sequence
  neuraminidase__InfluenzaA__AHL90077
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguauuguuucaugguccaaagaaauccucaggacccaggagucagaaugcguuuguaucaauggaacuuguacaguaguaaugacugaugggagugcuucaggaaaagcugauacuaaaauacuauucauuaaggaggggaaaaucguucauacuagcacauugucaggaagugcucagcaugucgaggagugcuccugcuauccucgauauccugguguuagaugugucugcagagacaacuggaaagguuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcacuucagguacauauggaacaggcucauggccugauggggcggacaucaaucucaugccuauauaa

SEQ ID NO: 55099 - RNA, 1410 nt, Artificial Sequence
  neuraminidase__InfluenzaA__AHL90089
augaauccaaaucaaaagauaauaacgauuggcucuguuucucucaccauuuccacaauaugcuucuucaugcaaacugccaucuugauaacuacuguaacauugcauuucaagcaauaugaauucaacuccccuccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgcgauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauaguauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55100 - RNA, 1410 nt, Artificial Sequence; identical to SEQ ID NO: 47247
  neuraminidase__InfluenzaA__AHL90101

SEQ ID NO: 55101 - RNA, 1410 nt, Artificial Sequence; identical to SEQ ID NO: 55085
  neuraminidase__InfluenzaA__AHL90113

SEQ ID NO: 55102 - RNA, 1413 nt, Artificial Sequence
  neuraminidase__InfluenzaA__AHL90125
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaauuggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaauuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugaucugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55103 - RNA, 1413 nt, Artificial Sequence
  neuraminidase__InfluenzaA__AHL90136
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacucuggcauggugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuaggaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55104 - RNA, 1413 nt, Artificial Sequence
  neuraminidase__InfluenzaA__AHL90160
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugaucugggauccuaauggauggacaaauaccgacagugauuucucagugaaacaggauguuguagcaauaacugauuggucaggauacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55105 - RNA, 1413 nt, Artificial Sequence
  neuraminidase__InfluenzaA__AHL90172
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggggaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccuuccccauacaauucaaaguucgaaucaguugcauggucagcaagcgcaugccaugauggcaugggcugguuaacaauuggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaauuggcaugguucaaaucgaccuugggugucuuuuaaucaaaacuuggauuaucaaauaggauacaucugcaguggaguguucggugacaauccgcgucccgaagauggagagggcaacugcaauccagugacuguugauggagcaaacggaguaaaaggguuuucauacaaauaugguaaugguguuuggauaggaaggaccaaaaguaacagacuuagaaagggguuugagaugaucugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55106 - RNA, 1413 nt, Artificial Sequence
  neuraminidase__InfluenzaA__AHL90184
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuagcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggauacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55107 - RNA, 1413 nt, Artificial Sequence
  neuraminidase__InfluenzaA__AHL90196
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaaaccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55108 - RNA, 1413 nt, Artificial Sequence
  neuraminidase__InfluenzaA__AHL90220
augaacccaaaucaaaagauaauaaccauuggaucaaucaguauagcaaucggaauaauuagucuaauguugcaaauaggaaauauuauuucaauaugggcuagucauucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaacccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55109 - RNA, 1413 nt, Artificial Sequence
  neuraminidase__InfluenzaA__AHL90232
augaacccaaaucaaaagauaauaaccauuggaucaaucaguauagcaaucggaauaauuagucuaauguugcaaauaggaaauauuauuucaauaugggcuagucauucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaacccgcgucccgaagauggagagggcagcugcaauccagugacuguuaauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55110 - RNA, 1413 nt, Artificial Sequence
  neuraminidase__InfluenzaA__AHL90244
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguuaaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccaaugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcuaccuagagaaaauacaacaaucuggacuagugggagcagcauuucuuuuuguggcguuaauagugauacugcaagcuggucuuggccagacggugcugaguugccguucaccauugacaaguag

SEQ ID NO: 55111 - RNA, 1413 nt, Artificial Sequence
  neuraminidase__InfluenzaA__AHL90256
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55112 - RNA, 1413 nt, Artificial Sequence
  neuraminidase__InfluenzaA__AHL90268
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuagcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacgggguaaaaggguuuucauacaaauaugauaaugguguuuggauaggaaggaccaaaaguaacagacuuagaaagggguuugagaugauuugggauccuaauggauggacaaauaccgaccgugauuucucagugaaacaggauguuguagcaauaacugauuggucaggguacagcggaaguuucguccaacauccugaguuaacaggauuggacuguauaagaccuugcuucuggguugaguuagucagagggcugccuagggaaaauacaacaaucuggacuagugggagcagcauuucuuuuuguggcguuaauagugauacugcaaacuggucuuggccagacggugcugaguugccguucaccauugacaaguag

SEQ ID NO: 55113 - RNA, 1413 nt, Artificial Sequence
  neuraminidase__InfluenzaA__AHL90280
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggaaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55114 - RNA, 1413 nt, Artificial Sequence
  neuraminidase__InfluenzaA__AHL90304
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacugaaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauaccgcaaacuggucuuggccagacggugcugaguugccguucaccauugacaaguag

SEQ ID NO: 55115 - RNA, 1413 nt, Artificial Sequence
  neuraminidase__InfluenzaA__AHL90316
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaauggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacaguggaaguuucguccaacauccugaguuaacaggacuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55116 - RNA, 1413 nt, Artificial Sequence
  neuraminidase__InfluenzaA__AHL90328
augaacccaaauaaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaauggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaguaacugauuggucaggguacaguggaaguuucguccaacauccugaguuaacaggacuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55117 - RNA, 1413 nt, Artificial Sequence; identical to SEQ ID NO: 55115
  neuraminidase__InfluenzaA__AHL90340

SEQ ID NO: 55118 - RNA, 1413 nt, Artificial Sequence
  neuraminidase__InfluenzaA__AHL90352
augaacccaaaucaaaagauaaugaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaccacacauaugucaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccauccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugauaauccgcgucccgaagauggagagggcagcugcaguccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggaugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55119 - RNA, 1413 nt, Artificial Sequence
  neuraminidase__InfluenzaA__AHL90364
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaagaccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaauggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacaguggaaguuucguccaacauccugaguuaacaggacuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55120 - RNA, 1413 nt, Artificial Sequence
  neuraminidase__InfluenzaA__AHL90376
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcaguugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55121 - RNA, 1410 nt, Artificial Sequence
  neuraminidase__InfluenzaA__AHL90388
augaauccaaaucaaaagauaauaacgauuggcucuguuucucucaucauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaucauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55122 - RNA, 1410 nt, Artificial Sequence
  neuraminidase__InfluenzaA__AHL90400
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55123 - RNA, 1410 nt, Artificial Sequence; identical to SEQ ID NO: 47763
  neuraminidase__InfluenzaA__AHL90413

SEQ ID NO: 55124 - RNA, 1410 nt, Artificial Sequence
  neuraminidase__InfluenzaA__AHL90425
augaauccaaaucaaaagauaauaacgauuggcucuguuucucucaccauuuccacaauaugcuucuucaugcaaacugccaucuugauaacuacuguaacauugcauuucaagcaguaugaauucaacucccccccaaacaaccaagugaugcugugugaaccaacaauaauagaaagaaacauaacagagauaguguaucugaccaacaccaccauagaaaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccucggacagggaacaacacuaaacaacgugcauucaaaugacacaguacaugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauuacagauaaauaggcaagucauaguugacagaggugauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55125 - RNA, 1410 nt, Artificial Sequence
  neuraminidase__InfluenzaA__AHL90437
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguagaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55126 - RNA, 1410 nt, Artificial Sequence; identical to SEQ ID NO: 47018
  neuraminidase__InfluenzaA__AHL90449

SEQ ID NO: 55127 - RNA, 1410 nt, Artificial Sequence; identical to SEQ ID NO: 47763
  neuraminidase__InfluenzaA__AHL90461

SEQ ID NO: 55128 - RNA, 1410 nt, Artificial Sequence
  neuraminidase__InfluenzaA__AHL90473
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaauccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55129 - RNA, 1410 nt, Artificial Sequence; identical to SEQ ID NO: 47018
  neuraminidase__InfluenzaA__AHL90485

SEQ ID NO: 55130 - RNA, 1410 nt, Artificial Sequence; identical to SEQ ID NO: 47140
  neuraminidase__InfluenzaA__AHL90497

SEQ ID NO: 55131 - RNA, 1410 nt, Artificial Sequence; identical to SEQ ID NO: 47140
  neuraminidase__InfluenzaA__AHL90509

SEQ ID NO: 55132 - RNA, 1410 nt, Artificial Sequence
  neuraminidase__InfluenzaA__AHL90521
augaauccaaaucaaaagauaauaacgauuggcucuguuucucucaccauuuccacaauaugcuucuucuugcaaauugccaucuugauaacuacuguaacauugcauuucaagcaauaugaauucaauucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacgacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacaggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguugaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuuuaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauaugggacaggcucauggccugauggggcggacaucaaucucaugccuauauaa

SEQ ID NO: 55133 - RNA, 1410 nt, Artificial Sequence
  neuraminidase__InfluenzaA__AHL90533
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccucggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauucucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugaaagaggugauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55134 - RNA, 1410 nt, Artificial Sequence
  neuraminidase__InfluenzaA__AHL90545
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgccuaggguaugaaaccuucaaagucauugaaggcugguccaacccuaaguccaaauugcagauaaauaggcaagucauaguugacagaggcaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55135 - RNA, 1410 nt, Artificial Sequence
  neuraminidase__InfluenzaA__AHL90557
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55136 - RNA, 1410 nt, Artificial Sequence
  neuraminidase__InfluenzaA__AHL90569
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuaaaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55137 - RNA, 1410 nt, Artificial Sequence
  neuraminidase__InfluenzaA__AHL90581
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccaaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55138 - RNA, 1410 nt, Artificial Sequence; identical to SEQ ID NO: 47140
  neuraminidase__InfluenzaA__AHL90593

SEQ ID NO: 55139 - RNA, 1410 nt, Artificial Sequence
  neuraminidase__InfluenzaA__AHL90605
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 55140 - RNA, 1410 nt, Artificial Sequence; identical to SEQ ID NO: 47103
  neuraminidase__InfluenzaA__AHL90629

SEQ ID NO: 55141 - RNA, 1410 nt, Artificial Sequence; identical to SEQ ID NO: 47103
  neuraminidase__InfluenzaA__AHL90641

SEQ ID NO: 55142 - RNA, 1410 nt, Artificial Sequence; identical to SEQ ID NO: 47018
  neuraminidase__InfluenzaA__AHL90653

SEQ ID NO: 55143 - RNA, 1410 nt, Artificial Sequence
  neuraminidase__InfluenzaA__AHL90665
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuugucggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55144 - RNA, 1410 nt, Artificial Sequence
  neuraminidase__InfluenzaA__AHL90677
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaagaacgacagcuccagcaguagccauuguuuggauccuaacaaugaagaagguggucauggagugaaaggcugggccuuugaugauggaaaugacguauggaugggaagaacgaucagcgagaagucacgcuuaggguaugaaaccuucaaagucauugaaggcugguccaacccuaaguccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggagcggacaucaaucucaugccuauauaa

SEQ ID NO: 55145 - RNA, 1410 nt, Artificial Sequence
  neuraminidase__InfluenzaA__AHL90689
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacugaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55146 - RNA, 1410 nt, Artificial Sequence
  neuraminidase__InfluenzaA__AHL90701
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcuggugggggcaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 55147 - RNA, 1410 nt, Artificial Sequence
  neuraminidase__InfluenzaA__AHL90713
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgacccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 55148 - RNA, 1413 nt, Artificial Sequence; identical to SEQ ID NO: 50441
  neuraminidase__InfluenzaA__AHL90725

SEQ ID NO: 55149 - RNA, 1413 nt, Artificial Sequence; identical to SEQ ID NO: 50745
  neuraminidase__InfluenzaA__AHL90749

SEQ ID NO: 55150 - RNA, 1413 nt, Artificial Sequence; identical to SEQ ID NO: 50722
  neuraminidase__InfluenzaA__AHL90761

SEQ ID NO: 55151 - RNA, 1413 nt, Artificial Sequence
  neuraminidase__InfluenzaA__AHL90773
augaacccaaaucaaaagauaauaaccauuggaucaaucaguauagcaaucggaauaauuagucuaaugcugcaaauaggaaauauuauuucaauaugggcuagucacucaauucaaacuggaagucaaaacaacacuggaauaugcaaccaaagaaucaucacauaugaaaacagcaccugggugaaucacacauauguuaauauuaacaacacuaauguuguugcuggagaggacaaaacuucaaugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauagagagggcagcugcaauccagugacuguugauggagcaaacggaguaaaaggauuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 55152 - RNA, 1413 nt, Artificial Sequence
  neuraminidase__InfluenzaA__AHL90785
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguuaauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauauaacaaucuggacuagugggagcagcauuucuuuuuguggcguuaauagugauacugcaaacuggucuuggccagacggugcugaguugccguucaccauugacaaguag

SEQ ID NO: 55153 - RNA, 1413 nt, Artificial Sequence
  neuraminidase__InfluenzaA__AHL90797
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaacaaaaggaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauagcauguucucacuuggaaugcagaaccuuuuuucugacccaaggcgcucuauuaaaugacaaacauucaaaugggaccguaaaagacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccugacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgagugauaaggccgccucguacaaaauuuucaagaucgaaaaggggaagguuacuaaaucaauagaguugaaugcacccaauuuucauuaugaggaauguucuuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaguccagugacuguugauggagcaaacggaguaaaaggguuuucauacaaauaugauaaugguguuuggauaggaaggaccaaaaguaacagacuuagaaagggguuugaggugauuugggauccuaauggauggacaaauaccgacagugauuucucagugaaacaggauguuguagcaauaacugauuggucaggguacaguggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaauuggucuuggccagacggugcugaguugccguucaccauugacaaguag

SEQ ID NO: 55154 - RNA, 1413 nt, Artificial Sequence; identical to SEQ ID NO: 50722
  neuraminidase__InfluenzaA__AHL90809

SEQ ID NO: 55155 - RNA, 1413 nt, Artificial Sequence
  neuraminidase__InfluenzaA__AHL90821
augaacccaaaucaaaggauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucauacauauguuaauauuaacaacacuaacguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccggugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacacccugaguuaacaggauuggacuguauaagaccuugcuucuggguugaguuagucagagggcugccuagagaaaauacaacaaucuggacuagugggagcagcauuucuuuuuguggcgucaauagugauacugcaaacuggucuuggccagacggugcugaguugccguucaccauugacaaguag

SEQ ID NO: 55156 - RNA, 1413 nt, Artificial Sequence
  neuraminidase__InfluenzaA__AHL90833
augaacccaaaucaaaggauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucauacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaaugggauacaucugcaguggaguguuuggugacaauccgcgucccgaagauggagagggcagcugcaauccggugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacacccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55157 - RNA, 1413 nt, Artificial Sequence
  neuraminidase__InfluenzaA__AHL90845
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucaugcuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55158 - RNA, 1413 nt, Artificial Sequence; identical to SEQ ID NO: 50745
  neuraminidase__InfluenzaA__AHL90857

SEQ ID NO: 55159 - RNA, 1413 nt, Artificial Sequence; identical to SEQ ID NO: 55157
  neuraminidase__InfluenzaA__AHL90869

SEQ ID NO: 55160 - RNA, 1413 nt, Artificial Sequence
  neuraminidase__InfluenzaA__AHL90881
augaacccaaaucaaaagauaauaaccauuggaucaaucaguauagcaaucggaauaauuaguacaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuauaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55161 - RNA, 1413 nt, Artificial Sequence; identical to SEQ ID NO: 50441
  neuraminidase__InfluenzaA__AHL90893

SEQ ID NO: 55162 - RNA, 1413 nt, Artificial Sequence; identical to SEQ ID NO: 50745
  neuraminidase__InfluenzaA__AHL90905

SEQ ID NO: 55163 - RNA, 1413 nt, Artificial Sequence
  neuraminidase__InfluenzaA__AHL90917
augaacccaaaucaaaagauaauaaccauuggaucaaucaguauagcaaucggaauaauuagucuaacguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaccaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55164 - RNA, 1413 nt, Artificial Sequence
  neuraminidase__InfluenzaA__AHL90929
augaacccaaaucaaaagauaauaaccauuggaucaaucaguauagcaaucggaauaauuagucuaauguugcaaauaggaaauauuauuucaauaugggcuagucacucaauucaaacuggaagucaaaacaacacuggaauaugcaaccaaagaaucaucacauaugaaaacagcaccugggugaaucacacauauguuaauauuaacaacacuaauguuguugcuggagaggacaaaacuucaaugacauuggccggcaauucaucucuuuguucuaucaguggaugggcuauauacacaaaagacaacagcauaagaauuggcuccaaaggagauguuuuugucauaagagaaccuuucauaucauguucccacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggauuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 55165 - RNA, 1413 nt, Artificial Sequence; identical to SEQ ID NO: 50745
  neuraminidase__InfluenzaA__AHL90941

SEQ ID NO: 55166 - RNA, 1413 nt, Artificial Sequence; identical to SEQ ID NO: 50745
  neuraminidase__InfluenzaA__AHL90953

SEQ ID NO: 55167 - RNA, 1413 nt, Artificial Sequence; identical to SEQ ID NO: 50745
  neuraminidase__InfluenzaA__AHL90965

SEQ ID NO: 55168 - RNA, 1413 nt, Artificial Sequence
  neuraminidase__InfluenzaA__AHL90977
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaaggacacaagagucugaaugugucuguaugaacgggucauguuucaccauaaugaccgauggcccgaguaauaaggcugccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacauaugcaguggaguguuuggugacaauccgcgucccgaagauggagaaggcagcugcaauccagugacuguugauggagcaaauggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauagcugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 55169 - RNA, 1413 nt, Artificial Sequence; identical to SEQ ID NO: 50708
  neuraminidase__InfluenzaA__AHL90989

SEQ ID NO: 55170 - RNA, 1413 nt, Artificial Sequence
  neuraminidase__InfluenzaA__AHL91001
augaacccaaaucaaaagauaauaaccauuggaucaaucaguauagcaaucggaauaauuagucuaauguugcaaauaggaaauauuauuucaauaugggcuagucacucaauucaaacuggaagucaaaacaacacuggaauaugcaaccaaagaaucaucacauaugaaaacagcaccugggugaaucacacauauguuaauauuaacaacacuaauguuguugcuggagaggacaaaacuucaaugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggauuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 55171 - RNA, 1413 nt, Artificial Sequence
  neuraminidase__InfluenzaA__AHL91013
augaacccaaaucaaaagauaauaaccauuggaucaaucaguauagcaaucggaauaauuagucuaauguugcaaauaggaaauauuauuucaauaugggcuagucacucaauucaaacuggaagucaaaacaacacuggaauaugcagccaaagaaucaucacauaugaaaacagcaccugggugaaucacacauauguuaauauuaacaacacuaauguuguugcuggagaggacaaaacuucaaugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuguuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaagaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggauuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 55172 - RNA, 1413 nt, Artificial Sequence; identical to SEQ ID NO: 55170
  neuraminidase__InfluenzaA__AHL91025

SEQ ID NO: 55173 - RNA, 1410 nt, Artificial Sequence
  neuraminidase__InfluenzaA__AHL91037
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacugaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55174 - RNA, 1410 nt, Artificial Sequence
  neuraminidase__InfluenzaA__AHL91049
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55175 - RNA, 1410 nt, Artificial Sequence
  neuraminidase__InfluenzaA__AHL91061
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgguauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuugaauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 55176 - RNA, 1410 nt, Artificial Sequence
  neuraminidase__InfluenzaA__AHL91073
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaacuuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcgguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55177 - RNA, 1410 nt, Artificial Sequence
  neuraminidase__InfluenzaA__AHL91085
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaaaaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauacucaggacccaggagucagaaugcguuuguaucaauggaauuuguaccguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauuguuuccaguuauguguguucaggacuuguuggagacacacccagaaaaaacgacagcuccagcaguagccauuguuuggaucccaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55178 - RNA, 1410 nt, Artificial Sequence
  neuraminidase__InfluenzaA__AHL91097
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucgaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55179 - RNA, 1410 nt, Artificial Sequence
  neuraminidase__InfluenzaA__AHL91109
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccacuauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucauuuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaauaucaugccuauauaa

SEQ ID NO: 55180 - RNA, 1410 nt, Artificial Sequence
  neuraminidase__InfluenzaA__AHL91121
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggcgucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55181 - RNA, 1410 nt, Artificial Sequence
  neuraminidase__InfluenzaA__AHL91133
augaauccaaaucaaaagauaauaacgauuggcucuguuucucucaccauuuccacaauaugcuucuucaugcaaauugccaucuugauaacuacuguaacauugcauuucaagcaauuugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55182 - RNA, 1410 nt, Artificial Sequence
  neuraminidase__InfluenzaA__AHL91145
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacacugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccacuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 55183 - RNA, 1410 nt, Artificial Sequence; identical to SEQ ID NO: 55182
  neuraminidase__InfluenzaA__AHL91157

SEQ ID NO: 55184 - RNA, 1410 nt, Artificial Sequence; identical to SEQ ID NO: 46236
  neuraminidase__InfluenzaA__AHL91169

SEQ ID NO: 55185 - RNA, 1410 nt, Artificial Sequence; identical to SEQ ID NO: 54358
  neuraminidase__InfluenzaA__AHL94987

SEQ ID NO: 55186 - RNA, 1410 nt, Artificial Sequence; identical to SEQ ID NO: 54358
  neuraminidase__InfluenzaA__AHL94999

SEQ ID NO: 55187 - RNA, 1410 nt, Artificial Sequence
  neuraminidase__InfluenzaA__AHL95011
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcucaagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguucaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55188 - RNA, 1410 nt, Artificial Sequence; identical to SEQ ID NO: 54407
  neuraminidase__InfluenzaA__AHL95023

SEQ ID NO: 55189 - RNA, 1410 nt, Artificial Sequence; identical to SEQ ID NO: 54357
  neuraminidase__InfluenzaA__AHL95035

SEQ ID NO: 55190 - RNA, 1410 nt, Artificial Sequence; identical to SEQ ID NO: 54372
  neuraminidase__InfluenzaA__AHL95047

SEQ ID NO: 55191 - RNA, 1410 nt, Artificial Sequence
  neuraminidase__InfluenzaA__AHL95059
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgguccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55192 - RNA, 1410 nt, Artificial Sequence
  neuraminidase__InfluenzaA__AHL95071
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55193 - RNA, 1410 nt, Artificial Sequence; identical to SEQ ID NO: 54409
  neuraminidase__InfluenzaA__AHL95083

SEQ ID NO: 55194 - RNA, 1410 nt, Artificial Sequence; identical to SEQ ID NO: 54372
  neuraminidase__InfluenzaA__AHL95095

SEQ ID NO: 55195 - RNA, 1410 nt, Artificial Sequence; identical to SEQ ID NO: 54372
  neuraminidase__InfluenzaA__AHL95107

SEQ ID NO: 55196 - RNA, 1410 nt, Artificial Sequence
  neuraminidase__InfluenzaA__AHL95119
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaauaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguucuugcuauccucgauauccuggugucagaugugucugcagagacaacuggaaaggcuccaacaggccuaucguagauauaaacauaaaggaucauagcauuguuuccagguauguguguucaggacuuguuggagacacacccagaaaaaacgacagcuuaagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggagcggaccucaaucucaugccuauauaa

SEQ ID NO: 55197 - RNA, 1410 nt, Artificial Sequence
  neuraminidase__InfluenzaA__AHL95131
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagauguguaugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55198 - RNA, 1410 nt, Artificial Sequence; identical to SEQ ID NO: 54387
  neuraminidase__InfluenzaA__AHL95143

SEQ ID NO: 55199 - RNA, 1410 nt, Artificial Sequence
  neuraminidase__InfluenzaA__AHL95155
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguagucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55200 - RNA, 1410 nt, Artificial Sequence
  neuraminidase__InfluenzaA__AHL95167
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauuuguguucaggacuuguuggagacacacccagaaaaaacgacagcucaagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55201 - RNA, 1410 nt, Artificial Sequence; identical to SEQ ID NO: 54372
  neuraminidase__InfluenzaA__AHL95179

SEQ ID NO: 55202 - RNA, 1410 nt, Artificial Sequence; identical to SEQ ID NO: 54372
  neuraminidase__InfluenzaA__AHL95191

SEQ ID NO: 55203 - RNA, 1410 nt, Artificial Sequence; identical to SEQ ID NO: 54357
  neuraminidase__InfluenzaA__AHL95203

SEQ ID NO: 55204 - RNA, 1410 nt, Artificial Sequence; identical to SEQ ID NO: 54372
  neuraminidase__InfluenzaA__AHL95215

SEQ ID NO: 55205 - RNA, 1410 nt, Artificial Sequence
  neuraminidase__InfluenzaA__AHL95227
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagagaaaacgacagcuccagcaguagccauuguuuggauccuaacaaugaagaagguggucauggagugaaaggaugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55206 - RNA, 1410 nt, Artificial Sequence
  neuraminidase__InfluenzaA__AHL95239
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55207 - RNA, 1410 nt, Artificial Sequence
  neuraminidase__InfluenzaA__AHL95251
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaggaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaguuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauuaaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55208 - RNA, 1410 nt, Artificial Sequence; identical to SEQ ID NO: 54357
  neuraminidase__InfluenzaA__AHL95263

SEQ ID NO: 55209 - RNA, 1410 nt, Artificial Sequence
  neuraminidase__InfluenzaA__AHL95275
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaucaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguugggcguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55210 - RNA, 1410 nt, Artificial Sequence; identical to SEQ ID NO: 54305
  neuraminidase__InfluenzaA__AHL95299

SEQ ID NO: 55211 - RNA, 1410 nt, Artificial Sequence
  neuraminidase__InfluenzaA__AHL95310
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcucaagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcgaaccucaaucucaugccuauauaa

SEQ ID NO: 55212 - RNA, 1410 nt, Artificial Sequence; identical to SEQ ID NO: 54398
  neuraminidase__InfluenzaA__AHL95322

SEQ ID NO: 55213 - RNA, 1410 nt, Artificial Sequence; identical to SEQ ID NO: 54375
  neuraminidase__InfluenzaA__AHL95334

SEQ ID NO: 55214 - RNA, 1410 nt, Artificial Sequence; identical to SEQ ID NO: 54372
  neuraminidase__InfluenzaA__AHL95423

SEQ ID NO: 55215 - RNA, 1410 nt, Artificial Sequence; identical to SEQ ID NO: 55191
  neuraminidase__InfluenzaA__AHL95435

SEQ ID NO: 55216 - RNA, 1410 nt, Artificial Sequence; identical to SEQ ID NO: 54375
  neuraminidase__InfluenzaA__AHL95447

SEQ ID NO: 55217 - RNA, 1410 nt, Artificial Sequence
  neuraminidase__InfluenzaA__AHL95461
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgguccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucgaugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55218 - RNA, 1410 nt, Artificial Sequence
  neuraminidase__InfluenzaA__AHL95473
augaauccaaaucaaaagauaauaacaauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55219 - RNA, 1410 nt, Artificial Sequence; identical to SEQ ID NO: 54357
  neuraminidase__InfluenzaA__AHL95485

SEQ ID NO: 55220 - RNA, 1410 nt, Artificial Sequence; identical to SEQ ID NO: 54357
  neuraminidase__InfluenzaA__AHL95497

SEQ ID NO: 55221 - RNA, 1410 nt, Artificial Sequence
  neuraminidase__InfluenzaA__AHL95509
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaagaaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55222 - RNA, 1410 nt, Artificial Sequence; identical to SEQ ID NO: 54372
  neuraminidase__InfluenzaA__AHL95521

SEQ ID NO: 55223 - RNA, 1410 nt, Artificial Sequence; identical to SEQ ID NO: 54372
  neuraminidase__InfluenzaA__AHL95533

SEQ ID NO: 55224 - RNA, 1410 nt, Artificial Sequence; identical to SEQ ID NO: 54372
  neuraminidase__InfluenzaA__AHL95545

SEQ ID NO: 55225 - RNA, 1410 nt, Artificial Sequence
  neuraminidase__InfluenzaA__AHL95557
augaauccaaaucaaaagauaauaacgauuggcucuguuucucucaccauuuccacaauaugcuucuucauucaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaccaauuugcccuuggacagggaacaacacuaaacaacgugcauucaaauaacacagcacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagauguguuugcagagacaacuggaaaggcuccaaucggcccaucguagauauaaacauaaaggaucauagcauuguuuccaguuauguguguucaggacuuguuggagacacacccagaaaaaacgacaguuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccugaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55226 - RNA, 1410 nt, Artificial Sequence; identical to SEQ ID NO: 54375
  neuraminidase__InfluenzaA__AHL95569

SEQ ID NO: 55227 - RNA, 1410 nt, Artificial Sequence; identical to SEQ ID NO: 54372
  neuraminidase__InfluenzaA__AHL95581

SEQ ID NO: 55228 - RNA, 1410 nt, Artificial Sequence
  neuraminidase__InfluenzaA__AHL95605
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacaucuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55229 - RNA, 1410 nt, Artificial Sequence; identical to SEQ ID NO: 54372
  neuraminidase__InfluenzaA__AHL95617

SEQ ID NO: 55230 - RNA, 1410 nt, Artificial Sequence; identical to SEQ ID NO: 54357
  neuraminidase__InfluenzaA__AHL95629

SEQ ID NO: 55231 - RNA, 1410 nt, Artificial Sequence; identical to SEQ ID NO: 54444
  neuraminidase__InfluenzaA__AHL95641

SEQ ID NO: 55232 - RNA, 1410 nt, Artificial Sequence
  neuraminidase__InfluenzaA__AHL95653
augaauccaaaucaaaagauaauaacgauugguucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaacaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55233 - RNA, 1410 nt, Artificial Sequence; identical to SEQ ID NO: 55228
  neuraminidase__InfluenzaA__AHL95665

SEQ ID NO: 55234 - RNA, 1410 nt, Artificial Sequence
  neuraminidase__InfluenzaA__AHL95677
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguauguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaucucaaucucaugccuauauaa

SEQ ID NO: 55235 - RNA, 1410 nt, Artificial Sequence
  neuraminidase__InfluenzaA__AHL95689
augaauccaaaucaaaagauaauaacgauuggcucuguuucucucaccauuuccacaauaugcuucuucaugcaaauugccaucuugauaacuacuguaacauugcauuucaagcaauaugaauucgauucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaggaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcgaaccucaaccucaugccuauauaa

SEQ ID NO: 55236 - RNA, 1410 nt, Artificial Sequence; identical to SEQ ID NO: 54361
  neuraminidase__InfluenzaA__AHL95701

SEQ ID NO: 55237 - RNA, 1410 nt, Artificial Sequence; identical to SEQ ID NO: 54372
  neuraminidase__InfluenzaA__AHL95713

SEQ ID NO: 55238 - RNA, 1410 nt, Artificial Sequence
  neuraminidase__InfluenzaA__AHL95725
augaauccaaaucaaaagauaauaacgauuggcucuguuucucucaccauuuccacaauaugcuucuucaugcaaauugccaucuugauaacuacuguaacauugcauuucaagcaauaugaauucgacccccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaauugaagucuuguggaccucaaacaguauuguuguguuuuguggcaccucagguacauauggaacaggcucauggccugauggggcggaccucaaccucaugccuauauaa

SEQ ID NO: 55239 - RNA, 1410 nt, Artificial Sequence
  neuraminidase__InfluenzaA__AHL95737
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaacgcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55240 - RNA, 1410 nt, Artificial Sequence
  neuraminidase__InfluenzaA__AHL95749
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacagcacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucuaaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacaucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55241 - RNA, 1410 nt, Artificial Sequence
  neuraminidase__InfluenzaA__AHL95761
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauucucagaacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucaacaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggacccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55242 - RNA, 1410 nt, Artificial Sequence; identical to SEQ ID NO: 54372
  neuraminidase__InfluenzaA__AHL95773

SEQ ID NO: 55243 - RNA, 1410 nt, Artificial Sequence
  neuraminidase__InfluenzaA__AHL95785
augaauccaaaucaaaagauaauaacgauuggcucuguuucucucaccauuuccacaauaugcuucuucaugcaaauugccaucuugauaacuacuguaacauugcauuucaaacaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggguuugcaccuuucucuaaggacaauucgguuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggugcagaccucaaucucaugccuauauaa

SEQ ID NO: 55244 - RNA, 1410 nt, Artificial Sequence; identical to SEQ ID NO: 54375
  neuraminidase__InfluenzaA__AHL95797

SEQ ID NO: 55245 - RNA, 1410 nt, Artificial Sequence; identical to SEQ ID NO: 54372
  neuraminidase__InfluenzaA__AHL95833

SEQ ID NO: 55246 - RNA, 1410 nt, Artificial Sequence; identical to SEQ ID NO: 54375
  neuraminidase__InfluenzaA__AHL95845

SEQ ID NO: 55247 - RNA, 1410 nt, Artificial Sequence
  neuraminidase__InfluenzaA__AHL95857
augaauccaaaucaaaagauaauaucgauuggcucuguuucucucaccauuuccacaauaugcuucuucaugcaaauugccaucuugauaaccacuguaacauugcauuucaagcaauaugaauucaacucccccccaaacaaucaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacguuaaacaacgugcauucaaacaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaaugggacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacucguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55248 - RNA, 1410 nt, Artificial Sequence; identical to SEQ ID NO: 54372
  neuraminidase__InfluenzaA__AHL95869

SEQ ID NO: 55249 - RNA, 1410 nt, Artificial Sequence
  neuraminidase__InfluenzaA__AHL95881
augaauccaaaccaaaagauaauaaccauugguucggucuguaugacaauuggaauggcuaacuuaauauuacaaauuggaaacauaaucucaauauggauuagccacucaauucaaguugggaaucaaagucagauugaaacaugcaaucaaagcgucauuacuuaugaaaacaacacuuggguaaaucagacauaugucaacaucagcaacaccaaccuugcugcugggcagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 55250 - RNA, 1410 nt, Artificial Sequence
  neuraminidase__InfluenzaA__AHL95892
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuucccguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55251 - RNA, 1410 nt, Artificial Sequence; identical to SEQ ID NO: 54357
  neuraminidase__InfluenzaA__AHL95904

SEQ ID NO: 55252 - RNA, 1410 nt, Artificial Sequence
  neuraminidase__InfluenzaA__AHL95916
augaauccaaaucaaaagauaauaacgauuggcucuguuucucucaccauuuccacaauaugcuucuucaugcaaauugccaucuugauaacuacuguaacauugcauuucaagcaauaugaauuaaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggagcugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55253 - RNA, 1410 nt, Artificial Sequence; identical to SEQ ID NO: 54387
  neuraminidase__InfluenzaA__AHL95928

SEQ ID NO: 55254 - RNA, 1410 nt, Artificial Sequence; identical to SEQ ID NO: 54375
  neuraminidase__InfluenzaA__AHL95940

SEQ ID NO: 55255 - RNA, 1410 nt, Artificial Sequence
  neuraminidase__InfluenzaA__AHL95952
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaagccagcagaauacagaaauuggucaaagccgcaauguggcauuaccggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaccuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaauguguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55256 - RNA, 1410 nt, Artificial Sequence; identical to SEQ ID NO: 54372
  neuraminidase__InfluenzaA__AHL95964

SEQ ID NO: 55257 - RNA, 1410 nt, Artificial Sequence; identical to SEQ ID NO: 54372
  neuraminidase__InfluenzaA__AHL95976

SEQ ID NO: 55258 - RNA, 1410 nt, Artificial Sequence
  neuraminidase__InfluenzaA__AHL95988
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaaguaugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55259 - RNA, 1410 nt, Artificial Sequence; identical to SEQ ID NO: 54372
  neuraminidase__InfluenzaA__AHL96000

SEQ ID NO: 55260 - RNA, 1410 nt, Artificial Sequence
  neuraminidase__InfluenzaA__AHL96012
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuagacuuuccgcugguggggacaucugggugacaagaguaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55261 - RNA, 1410 nt, Artificial Sequence
  neuraminidase__InfluenzaA__AHL96024
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguucccuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaaaucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55262 - RNA, 1410 nt, Artificial Sequence; identical to SEQ ID NO: 54444
  neuraminidase__InfluenzaA__AHL96036

SEQ ID NO: 55263 - RNA, 1410 nt, Artificial Sequence; identical to SEQ ID NO: 54305
  neuraminidase__InfluenzaA__AHL96048

SEQ ID NO: 55264 - RNA, 1410 nt, Artificial Sequence; identical to SEQ ID NO: 54357
  neuraminidase__InfluenzaA__AHL96059

SEQ ID NO: 55265 - RNA, 1410 nt, Artificial Sequence; identical to SEQ ID NO: 55206
  neuraminidase__InfluenzaA__AHL96071

SEQ ID NO: 55266 - RNA, 1410 nt, Artificial Sequence
  neuraminidase__InfluenzaA__AHL96083
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugagcuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacaucuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55267 - RNA, 1410 nt, Artificial Sequence; identical to SEQ ID NO: 54357
  neuraminidase__InfluenzaA__AHL96095

SEQ ID NO: 55268 - RNA, 1410 nt, Artificial Sequence
  neuraminidase__InfluenzaA__AHL96107
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacaacuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55269 - RNA, 1410 nt, Artificial Sequence; identical to SEQ ID NO: 53829
  neuraminidase__InfluenzaA__AHL96119

SEQ ID NO: 55270 - RNA, 1410 nt, Artificial Sequence; identical to SEQ ID NO: 55206
  neuraminidase__InfluenzaA__AHL96131

SEQ ID NO: 55271 - RNA, 1410 nt, Artificial Sequence
  neuraminidase__InfluenzaA__AHL96143
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaggaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacaucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55272 - RNA, 1410 nt, Artificial Sequence; identical to SEQ ID NO: 54357
  neuraminidase__InfluenzaA__AHL96167

SEQ ID NO: 55273 - RNA, 1410 nt, Artificial Sequence; identical to SEQ ID NO: 54357
  neuraminidase__InfluenzaA__AHL96179

SEQ ID NO: 55274 - RNA, 1410 nt, Artificial Sequence
  neuraminidase__InfluenzaA__AHL96191
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 55275 - RNA, 1410 nt, Artificial Sequence
  neuraminidase__InfluenzaA__AHL96203
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggaaaaagcugcaucaaucggugcuuuuauguggaguugauuaggggaagaaaagaggaaacugaaguuuuguggaccucaaacaguauuguuguguuuuguggcaccucagguacauauggaacaggcucauggccugauggggcggaccucaaccucaugccuauauaa

SEQ ID NO: 55276 - RNA, 1410 nt, Artificial Sequence
  neuraminidase__InfluenzaA__AHL96215
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggaucccaacaaugaagaagguggucauggagugaaaggcugggccuuugaugauggaaaugacguguggaugggaagaacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55277 - RNA, 1410 nt, Artificial Sequence
  neuraminidase__InfluenzaA__AHL96227
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagacauaaacauaaaggaucauagcauuguuuccaguuauguguguucaggacuuguuggagacacacccagaaaaaacgacagcuccagcagcagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55278 - RNA, 1410 nt, Artificial Sequence
  neuraminidase__InfluenzaA__AHL96239
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuagggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaaggcggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55279 - RNA, 1410 nt, Artificial Sequence
  neuraminidase__InfluenzaA__AHL96251
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugugauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55280 - RNA, 1410 nt, Artificial Sequence; identical to SEQ ID NO: 54369
  neuraminidase__InfluenzaA__AHL96263

SEQ ID NO: 55281 - RNA, 1410 nt, Artificial Sequence; identical to SEQ ID NO: 54431
  neuraminidase__InfluenzaA__AHL96277

SEQ ID NO: 55282 - RNA, 1410 nt, Artificial Sequence
  neuraminidase__InfluenzaA__AHL96308
augaauccaaaucaaaagauaauaacgauuggcucuguuucucucaccauuuccacaauaugcuucuucaugcaaauugccaucuugauaacuacuguaacauugcauuucaagcaauaugaauucaacuuccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugagugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55283 - RNA, 1410 nt, Artificial Sequence; identical to SEQ ID NO: 54468
  neuraminidase__InfluenzaA__AHL96321

SEQ ID NO: 55284 - RNA, 1410 nt, Artificial Sequence
  neuraminidase__InfluenzaA__AHL96333
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagacauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 55285 - RNA, 1410 nt, Artificial Sequence
  neuraminidase__InfluenzaA__AHL96345
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacaacuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55286 - RNA, 1410 nt, Artificial Sequence; identical to SEQ ID NO: 54375
  neuraminidase__InfluenzaA__AHL96357

SEQ ID NO: 55287 - RNA, 1410 nt, Artificial Sequence; identical to SEQ ID NO: 54357
  neuraminidase__InfluenzaA__AHL96369

SEQ ID NO: 55288 - RNA, 1410 nt, Artificial Sequence; identical to SEQ ID NO: 54372
  neuraminidase__InfluenzaA__AHL96381

SEQ ID NO: 55289 - RNA, 1410 nt, Artificial Sequence; identical to SEQ ID NO: 54387
  neuraminidase__InfluenzaA__AHL96393

SEQ ID NO: 55290 - RNA, 1410 nt, Artificial Sequence
  neuraminidase__InfluenzaA__AHL96405
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggacuaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauuaucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggguccuaacaaugaagaagguggucauggagugaaaggcugggccuuugaugauggaaaugacguguggaugggaagaacaaucaacgagacgucacgcuuaggguaugaaacauucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55291 - RNA, 1410 nt, Artificial Sequence
  neuraminidase__InfluenzaA__AHL96417
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55292 - RNA, 1410 nt, Artificial Sequence; identical to SEQ ID NO: 54357
  neuraminidase__InfluenzaA__AHL96429

SEQ ID NO: 55293 - RNA, 1410 nt, Artificial Sequence
  neuraminidase__InfluenzaA__AHL96441
augaauccaaaucaaaagauaauaacgauuggcucuguuucucucaccauuuccacaauaugcuucuucaugcaaauugccaucuugauaacuacuguaacauugcauuucaagcauuaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaauguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuugaauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcagaucauaguugacagaggugauagguccgguuauucugguauuuucucuguugaaggcaaaagcugcaucaaucggugcuuuuauguggaguugauuagaggaagaaaagaggaaaccgaagucuuguggaccucaaacaguauuguuguguuuuguggcaccucagguacauauggaacaggcucauggccugauggggcggaccucaaucucaugccuauauaa

SEQ ID NO: 55294 - RNA, 1410 nt, Artificial Sequence; identical to SEQ ID NO: 54372
  neuraminidase__InfluenzaA__AHL96453

SEQ ID NO: 55295 - RNA, 1410 nt, Artificial Sequence; identical to SEQ ID NO: 54357
  neuraminidase__InfluenzaA__AHL96465

SEQ ID NO: 55296 - RNA, 1410 nt, Artificial Sequence
  neuraminidase__InfluenzaA__AHL96477
augaauccaaaccaaaagauaauaaccauugguucggucuguaugacaauuggaauggcuaacuuaauauuacaaauuggaaacauaaucucaauauggauuagccacucaauucaaguugggaaucaaagucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 55297 - RNA, 1410 nt, Artificial Sequence
  neuraminidase__InfluenzaA__AHL96488
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauacccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55298 - RNA, 1410 nt, Artificial Sequence; identical to SEQ ID NO: 54357
  neuraminidase__InfluenzaA__AHL96500

SEQ ID NO: 55299 - RNA, 1410 nt, Artificial Sequence; identical to SEQ ID NO: 54444
  neuraminidase__InfluenzaA__AHL96512

SEQ ID NO: 55300 - RNA, 1410 nt, Artificial Sequence
  neuraminidase__InfluenzaA__AHL96524
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcucaagcaguagccauuguuuggauccuaauaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55301 - RNA, 1410 nt, Artificial Sequence
  neuraminidase__InfluenzaA__AHL96536
augaauccaaaucaaaagauaauaacgauuggcucuguuucucucaccauuuccacaauaugcuucuucacgcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccaucgagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacaauaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggagcggaccucaaucucaugccuauauaa

SEQ ID NO: 55302 - RNA, 1410 nt, Artificial Sequence; identical to SEQ ID NO: 55206
  neuraminidase__InfluenzaA__AHL96548

SEQ ID NO: 55303 - RNA, 1410 nt, Artificial Sequence
  neuraminidase__InfluenzaA__AHL96560
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaaaugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55304 - RNA, 1410 nt, Artificial Sequence; identical to SEQ ID NO: 53871
  neuraminidase__InfluenzaA__AHL96572

SEQ ID NO: 55305 - RNA, 1410 nt, Artificial Sequence; identical to SEQ ID NO: 55296
  neuraminidase__InfluenzaA__AHL96584

SEQ ID NO: 55306 - RNA, 1410 nt, Artificial Sequence
  neuraminidase__InfluenzaA__AHL96595
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaagcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55307 - RNA, 1410 nt, Artificial Sequence; identical to SEQ ID NO: 54357
  neuraminidase__InfluenzaA__AHL96607

SEQ ID NO: 55308 - RNA, 1410 nt, Artificial Sequence
  neuraminidase__InfluenzaA__AHL96631
augaauccaaaucaaaagauaauaacgauuggcucuguuucucucaccauuuccacaauaugcuucuucaugcaaauugccaucuugauaacuacuguaacauugcauuucaagcaauaugaauucaacucccucccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcgugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55309 - RNA, 1410 nt, Artificial Sequence; identical to SEQ ID NO: 54387
  neuraminidase__InfluenzaA__AHL96643

SEQ ID NO: 55310 - RNA, 1410 nt, Artificial Sequence; identical to SEQ ID NO: 54361
  neuraminidase__InfluenzaA__AHL96655

SEQ ID NO: 55311 - RNA, 1410 nt, Artificial Sequence
  neuraminidase__InfluenzaA__AHL96667
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagaaugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55312 - RNA, 1410 nt, Artificial Sequence; identical to SEQ ID NO: 55271
  neuraminidase__InfluenzaA__AHL96679

SEQ ID NO: 55313 - RNA, 1410 nt, Artificial Sequence; identical to SEQ ID NO: 54357
  neuraminidase__InfluenzaA__AHL96691

SEQ ID NO: 55314 - RNA, 1410 nt, Artificial Sequence
  neuraminidase__InfluenzaA__AHL96703
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggauaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55315 - RNA, 1410 nt, Artificial Sequence; identical to SEQ ID NO: 54375
  neuraminidase__InfluenzaA__AHL96763

SEQ ID NO: 55316 - RNA, 1410 nt, Artificial Sequence
  neuraminidase__InfluenzaA__AHL96787
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacaucuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauuacagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55317 - RNA, 1410 nt, Artificial Sequence
  neuraminidase__InfluenzaA__AHL96799
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaugaaacugaagucuuguggaccucaaacaguauuguuguguuuuguggcaccucagguacauauggaacaggcucauggccugauggggcggaccucaaucucaugccuauauaa

SEQ ID NO: 55318 - RNA, 1410 nt, Artificial Sequence; identical to SEQ ID NO: 54387
  neuraminidase__InfluenzaA__AHL96811

SEQ ID NO: 55319 - RNA, 1410 nt, Artificial Sequence
  neuraminidase__InfluenzaA__AHL96823
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacccuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55320 - RNA, 1410 nt, Artificial Sequence; identical to SEQ ID NO: 54372
  neuraminidase__InfluenzaA__AHL96847

SEQ ID NO: 55321 - RNA, 1410 nt, Artificial Sequence
  neuraminidase__InfluenzaA__AHL96859
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55322 - RNA, 1410 nt, Artificial Sequence
  neuraminidase__InfluenzaA__AHL96871
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaguagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuucugcugguggggacaucugggugacaagagaaccuuaugugucaugugauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggagacuuguagauaguguuguuucaugguccaaagaaguucucaggacccaggagucagaaugcguuuguaucaauggaacuugugcaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagauccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaaguuauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55323 - RNA, 1410 nt, Artificial Sequence
  neuraminidase__InfluenzaA__AHL96883
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaucagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55324 - RNA, 1410 nt, Artificial Sequence; identical to SEQ ID NO: 54375
  neuraminidase__InfluenzaA__AHL96895

SEQ ID NO: 55325 - RNA, 1410 nt, Artificial Sequence
  neuraminidase__InfluenzaA__AHL96907
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaguagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuucugcugguggggacaucugggugacaagagaaccuuaugugucaugugauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggagacuuguagauaguguuguuucaugguccaaagaaguucucaggacccaggagucagaaugcguuuguaucaauggaacuugugcaguaguaaugacugauggaagugcuucaggaaaagcugauacuaaaauacuauucauugaggaggggaaaaucguucauacuagcacauugucaggaagugcucagcacgucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaaguuauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55326 - RNA, 1410 nt, Artificial Sequence; identical to SEQ ID NO: 54387
  neuraminidase__InfluenzaA__AHL96919

SEQ ID NO: 55327 - RNA, 1410 nt, Artificial Sequence; identical to SEQ ID NO: 55276
  neuraminidase__InfluenzaA__AHL96931

SEQ ID NO: 55328 - RNA, 1410 nt, Artificial Sequence; identical to SEQ ID NO: 55276
  neuraminidase__InfluenzaA__AHL96943

SEQ ID NO: 55329 - RNA, 1410 nt, Artificial Sequence
  neuraminidase__InfluenzaA__AHL96955
augaauccaaaucaaaagauaauaacgauuggcucuguuucucucaccauuuccacaauaugcuucuucaugcaaauugccaucuugauaacuacuguaacauugcauuucaagcaauaugaauucaacucccccucaaacaaccaagugaugcugugugaaccaacaauaauagaaagaaacauaacagagauaguguaucugaccaacaccaccauagagaaggaaauaugccccaaaccagcagaauauagaaauuggucaaaaccgcaauguggcauuacaggauuugcaccuuucucuaaggacaauucgauuaggcuuuccgcuggugggaacaucugggugacaagagaaccuuaugugucaugcgaucccgacaaguguuaucaauuugcccuuggacagggaacaacacuaaacaacgugcauucaaauaacacaguacgugauagaaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55330 - RNA, 1410 nt, Artificial Sequence
  neuraminidase__InfluenzaA__AHL96967
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaccuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacaucuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55331 - RNA, 1410 nt, Artificial Sequence
  neuraminidase__InfluenzaA__AHL96979
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacaugcauucaaauaacacaguacgugauaggaccccuuaucggacccuauugaugaaugaguuggguguuccuuuucaucuggggaccaagcaagugugcauagcaugguccagcucaagcugucacgauggaaaagcauggcugcauguuuguauaacgggggaugauaaaaaugcaacugcuagcuucauuuacaauggaaggcuuguagauaguguuguuucaugguccaaagaaauccucaggacccaggagucagaaugcguuugcaucaauggaacuuguacaguaguaaugacugaugggagugcuucgggaaaagcugauacuaaaauacuauucauugaggaggggaaaaucguucauacuagcacauugucaggaagugcucagcaugucgaggagugcucuugcuauccucgauacccuggugucagaugugucugcagagacaacuggaaaggcuccaauaggcccaucguagauauaaacauaaaggaucauagcauuguuuccaguuauguguguucagggcuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggcgauagguccgguuauucugguauuuucucuguugaaggcaaaagcugcaucaaucggugcuuuuauguggaguugaucaggggaagaaaagaggaaacugaagucuuguggaccucaaacaguauuguuguguuuuguggcaccucaggcacauauggaacaggcucauggccugauggggcggaccucaauaucaugccuauauaa

SEQ ID NO: 55332 - RNA, 1410 nt, Artificial Sequence
  neuraminidase__InfluenzaA__AHL96991
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgcgauaggaccccuuaucggacucuauugaugaaugaguuggguguuccuuuucaucuggggaccaagcaaguguguauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55333 - RNA, 1410 nt, Artificial Sequence; identical to SEQ ID NO: 54372
  neuraminidase__InfluenzaA__AHL97003

SEQ ID NO: 55334 - RNA, 1410 nt, Artificial Sequence
  neuraminidase__InfluenzaA__AHL97015
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaaaucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55335 - RNA, 1410 nt, Artificial Sequence; identical to SEQ ID NO: 54372
  neuraminidase__InfluenzaA__AHL97027

SEQ ID NO: 55336 - RNA, 1410 nt, Artificial Sequence
  neuraminidase__InfluenzaA__AHL97039
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaaaugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggauuauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55337 - RNA, 1410 nt, Artificial Sequence; identical to SEQ ID NO: 53856
  neuraminidase__InfluenzaA__AHL97051

SEQ ID NO: 55338 - RNA, 1410 nt, Artificial Sequence
  neuraminidase__InfluenzaA__AHL97063
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgcgauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggguccuaacaaugaagaagguggucauggagugaaaggcugggccuuugaugauggaaaugacguguggaugggaagaacaaucaacgagacgucacgcuuaggguaugaaaccuucaaagucauugacggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55339 - RNA, 1410 nt, Artificial Sequence
  neuraminidase__InfluenzaA__AHL97075
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 55340 - RNA, 1410 nt, Artificial Sequence; identical to SEQ ID NO: 54375
  neuraminidase__InfluenzaA__AHL97087

SEQ ID NO: 55341 - RNA, 1410 nt, Artificial Sequence; identical to SEQ ID NO: 54468
  neuraminidase__InfluenzaA__AHL97099

SEQ ID NO: 55342 - RNA, 1410 nt, Artificial Sequence
  neuraminidase__InfluenzaA__AHL97111
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucgaguugucacgauggaaaagcauggcugcauguuuguauaacgggggaugauaaaaaugcaacugcuagcuuuauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55343 - RNA, 1410 nt, Artificial Sequence
  neuraminidase__InfluenzaA__AHL97123
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaagaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 55344 - RNA, 1410 nt, Artificial Sequence; identical to SEQ ID NO: 54407
  neuraminidase__InfluenzaA__AHL97135

SEQ ID NO: 55345 - RNA, 1410 nt, Artificial Sequence
  neuraminidase__InfluenzaA__AHL97147
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggagaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55346 - RNA, 1410 nt, Artificial Sequence
  neuraminidase__InfluenzaA__AHL97159
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauucgcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55347 - RNA, 1410 nt, Artificial Sequence; identical to SEQ ID NO: 54357
  neuraminidase__InfluenzaA__AHL97171

SEQ ID NO: 55348 - RNA, 1410 nt, Artificial Sequence; identical to SEQ ID NO: 54372
  neuraminidase__InfluenzaA__AHL97183

SEQ ID NO: 55349 - RNA, 1410 nt, Artificial Sequence; identical to SEQ ID NO: 54357
  neuraminidase__InfluenzaA__AHL97195

SEQ ID NO: 55350 - RNA, 1410 nt, Artificial Sequence; identical to SEQ ID NO: 54357
  neuraminidase__InfluenzaA__AHL97207

SEQ ID NO: 55351 - RNA, 1410 nt, Artificial Sequence; identical to SEQ ID NO: 54372
  neuraminidase__InfluenzaA__AHL97219

SEQ ID NO: 55352 - RNA, 1410 nt, Artificial Sequence
  neuraminidase__InfluenzaA__AHL97231
augaauccaaaucaaaagauaauaacgauuggcucuguuucucucaccauuuccacaauaugcuucuucaugcaaauugccaucuugauaacuacuguaacauugcauuucaagcaauaugacuucaacuccccuccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacccuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauaccaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcguuauuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauuggaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55353 - RNA, 1410 nt, Artificial Sequence
  neuraminidase__InfluenzaA__AHL97243
augaauccaaaucaaaagauaauaacgauuggcucuguuucucucaccauuuccacaauaugcuucuucaugcaaauugccaucuugauaacuacuguaacauugaauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55354 - RNA, 1410 nt, Artificial Sequence; identical to SEQ ID NO: 54468
  neuraminidase__InfluenzaA__AHL97255

SEQ ID NO: 55355 - RNA, 1410 nt, Artificial Sequence
  neuraminidase__InfluenzaA__AHL97267
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacagcacgugauaggaccccuuaucggacucuauugaugaaugaguuggguguuccuuuucaucuggggaccaagcaaguaugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuucagcaguagccauuguuuggauccuaacaaugaagaagguggucauggagugaaaggcugggccuuugaugauggaaaugacguauggaugggaagaacaaucaacgagacaucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacggaagucuuguggaccucaaacaguauuguuguguuuuguggcaccucagguacauauggaacaggcucauggccugauggggcggaccucaaucucaugccuauauaa

SEQ ID NO: 55356 - RNA, 1410 nt, Artificial Sequence; identical to SEQ ID NO: 54357
  neuraminidase__InfluenzaA__AHL97279

SEQ ID NO: 55357 - RNA, 1410 nt, Artificial Sequence
  neuraminidase__InfluenzaA__AHL97291
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacagcacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55358 - RNA, 1410 nt, Artificial Sequence
  neuraminidase__InfluenzaA__AHL97303
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacaucuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauagacaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55359 - RNA, 1410 nt, Artificial Sequence
  neuraminidase__InfluenzaA__AHL97339
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccucuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaagagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuucaaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 55360 - RNA, 1410 nt, Artificial Sequence; identical to SEQ ID NO: 54375
  neuraminidase__InfluenzaA__AHL97351

SEQ ID NO: 55361 - RNA, 1410 nt, Artificial Sequence; identical to SEQ ID NO: 55357
  neuraminidase__InfluenzaA__AHL97363

SEQ ID NO: 55362 - RNA, 1410 nt, Artificial Sequence; identical to SEQ ID NO: 54369
  neuraminidase__InfluenzaA__AHL97387

SEQ ID NO: 55363 - RNA, 1410 nt, Artificial Sequence
  neuraminidase__InfluenzaA__AHL97399
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaauguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcagaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55364 - RNA, 1410 nt, Artificial Sequence; identical to SEQ ID NO: 54468
  neuraminidase__InfluenzaA__AHL97411

SEQ ID NO: 55365 - RNA, 1410 nt, Artificial Sequence
  neuraminidase__InfluenzaA__AHL97423
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacauguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55366 - RNA, 1410 nt, Artificial Sequence
  neuraminidase__InfluenzaA__AHL97447
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuucagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55367 - RNA, 1410 nt, Artificial Sequence; identical to SEQ ID NO: 54372
  neuraminidase__InfluenzaA__AHL97459

SEQ ID NO: 55368 - RNA, 1410 nt, Artificial Sequence; identical to SEQ ID NO: 55357
  neuraminidase__InfluenzaA__AHL97471

SEQ ID NO: 55369 - RNA, 1410 nt, Artificial Sequence
  neuraminidase__InfluenzaA__AHL97483
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauaguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 55370 - RNA, 1410 nt, Artificial Sequence; identical to SEQ ID NO: 54357
  neuraminidase__InfluenzaA__AHL97496

SEQ ID NO: 55371 - RNA, 1410 nt, Artificial Sequence; identical to SEQ ID NO: 54372
  neuraminidase__InfluenzaA__AHL97508

SEQ ID NO: 55372 - RNA, 1410 nt, Artificial Sequence
  neuraminidase__InfluenzaA__AHL97520
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaacaugccccaaaccagcagaauacagaaauuggucaaaaccgcaauguggcauuacaggauuugcaccuuucucuaaggacaauucgauuaggcuuuccgcugguggggacaucugggugacaagagaaccuuauguaucaugcgguccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacaggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55373 - RNA, 1410 nt, Artificial Sequence
  neuraminidase__InfluenzaA__AHL97532
augaauccaaaucaaaagauaauaacgauuggcucuguuucucucaccauuuccacaauaugcuucuucaugcaaauugccaucuugauaacuacuguaacauugcauuucaagcaguaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaacgaagaagguggucauggagugaaaggcugggccuuugaugauggaaaugacguguggaugggaagaacaaucaacgagacgucacgcuuaggguaugaaaccuucaaagucauugaaggcugguccaaccccaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55374 - RNA, 1410 nt, Artificial Sequence; identical to SEQ ID NO: 54444
  neuraminidase__InfluenzaA__AHL97544

SEQ ID NO: 55375 - RNA, 1410 nt, Artificial Sequence; identical to SEQ ID NO: 54375
  neuraminidase__InfluenzaA__AHL97556

SEQ ID NO: 55376 - RNA, 1410 nt, Artificial Sequence
  neuraminidase__InfluenzaA__AHL97568
augaauccaaaucaaaagauaauaacgauuggcucuguuucucucaccauuuccgcaauaugcuucuucaugcaaauugccaucuugauaacuacuguaacauugcguuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaccaacgugcauucaaauaacacaguacgugauaggaccccuuaucggacccuauugaugaaugaguuagguguuccuuuucaucuggggaccaagcaagugugcauagcauggucuagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaggucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55377 - RNA, 1410 nt, Artificial Sequence
  neuraminidase__InfluenzaA__AHL97580
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggacuaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggguccuaacaaugaagaagguggucauggagugaaaggcugggccuuugaugauggaaaugacguguggaugggaagaacaaucaacgagacgucacgcuuaggguaugaaacauucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55378 - RNA, 1410 nt, Artificial Sequence
  neuraminidase__InfluenzaA__AHL97592
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgguuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggguccuaacaaugaagaagguggucauggagugaaaggcugggccuuugaugauggaaaugacguguggaugggaagaacaaucaacgagacgucacgcucaggguaugaaacauucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55379 - RNA, 1410 nt, Artificial Sequence; identical to SEQ ID NO: 54357
  neuraminidase__InfluenzaA__AHL97604

SEQ ID NO: 55380 - RNA, 1410 nt, Artificial Sequence
  neuraminidase__InfluenzaA__AHL97616
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaguucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55381 - RNA, 1410 nt, Artificial Sequence; identical to SEQ ID NO: 55357
  neuraminidase__InfluenzaA__AHL97628

SEQ ID NO: 55382 - RNA, 1410 nt, Artificial Sequence; identical to SEQ ID NO: 54372
  neuraminidase__InfluenzaA__AHL97640

SEQ ID NO: 55383 - RNA, 1410 nt, Artificial Sequence; identical to SEQ ID NO: 55191
  neuraminidase__InfluenzaA__AHL97652

SEQ ID NO: 55384 - RNA, 1410 nt, Artificial Sequence; identical to SEQ ID NO: 55191
  neuraminidase__InfluenzaA__AHL97664

SEQ ID NO: 55385 - RNA, 1410 nt, Artificial Sequence; identical to SEQ ID NO: 54468
  neuraminidase__InfluenzaA__AHL97676

SEQ ID NO: 55386 - RNA, 1410 nt, Artificial Sequence; identical to SEQ ID NO: 54357
  neuraminidase__InfluenzaA__AHL97688

SEQ ID NO: 55387 - RNA, 1410 nt, Artificial Sequence
  neuraminidase__InfluenzaA__AHL97700
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggagcugauuaggggaagaaaagaggaaacugaaguuuuguggaccucaaacaguauuguuguguuuuguggcaccucagguacauauggaacaggcucauggccugauggggcggaccucaaccucaugccuauauaa

SEQ ID NO: 55388 - RNA, 1410 nt, Artificial Sequence
  neuraminidase__InfluenzaA__AHL97712
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcaccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55389 - RNA, 1410 nt, Artificial Sequence; identical to SEQ ID NO: 54375
  neuraminidase__InfluenzaA__AHL97724

SEQ ID NO: 55390 - RNA, 1410 nt, Artificial Sequence; identical to SEQ ID NO: 54372
  neuraminidase__InfluenzaA__AHL97736

SEQ ID NO: 55391 - RNA, 1410 nt, Artificial Sequence
  neuraminidase__InfluenzaA__AHL97760
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugaugaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55392 - RNA, 1410 nt, Artificial Sequence
  neuraminidase__InfluenzaA__AHL97772
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguguuguuguguuuuguggcaccucagguacauauggaacaggcucauggccugauggggcggaccucaaucucaugccuauauaa

SEQ ID NO: 55393 - RNA, 1410 nt, Artificial Sequence
  neuraminidase__InfluenzaA__AHL97784
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcauggucuagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaggucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55394 - RNA, 1410 nt, Artificial Sequence
  neuraminidase__InfluenzaA__AHL97796
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcacccuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55395 - RNA, 1410 nt, Artificial Sequence; identical to SEQ ID NO: 54369
  neuraminidase__InfluenzaA__AHL97808

SEQ ID NO: 55396 - RNA, 1410 nt, Artificial Sequence; identical to SEQ ID NO: 54372
  neuraminidase__InfluenzaA__AHL97820

SEQ ID NO: 55397 - RNA, 1410 nt, Artificial Sequence
  neuraminidase__InfluenzaA__AHL97832
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaguuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggagcugauuaggggaagaaaagaggaaacugaaguuuuguggaccucaaacaguauuguuguguuuuguggcaccucagguacauauggaacaggcucauggccugauggggcggaccucaaccucaugccuauauaa

SEQ ID NO: 55398 - RNA, 1410 nt, Artificial Sequence; identical to SEQ ID NO: 54357
  neuraminidase__InfluenzaA__AHL97844

SEQ ID NO: 55399 - RNA, 1410 nt, Artificial Sequence; identical to SEQ ID NO: 55391
  neuraminidase__InfluenzaA__AHL97856

SEQ ID NO: 55400 - RNA, 1410 nt, Artificial Sequence; identical to SEQ ID NO: 54369
  neuraminidase__InfluenzaA__AHL97868

SEQ ID NO: 55401 - RNA, 1410 nt, Artificial Sequence; identical to SEQ ID NO: 54375
  neuraminidase__InfluenzaA__AHL97880

SEQ ID NO: 55402 - RNA, 1410 nt, Artificial Sequence; identical to SEQ ID NO: 54372
  neuraminidase__InfluenzaA__AHL97892

SEQ ID NO: 55403 - RNA, 1410 nt, Artificial Sequence
  neuraminidase__InfluenzaA__AHL97904
augaauccaaaucaaaaaauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcccagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55404 - RNA, 1410 nt, Artificial Sequence; identical to SEQ ID NO: 54387
  neuraminidase__InfluenzaA__AHL97916

SEQ ID NO: 55405 - RNA, 1410 nt, Artificial Sequence; identical to SEQ ID NO: 54358
  neuraminidase__InfluenzaA__AHL97928

SEQ ID NO: 55406 - RNA, 1410 nt, Artificial Sequence; identical to SEQ ID NO: 55366
  neuraminidase__InfluenzaA__AHL97952

SEQ ID NO: 55407 - RNA, 1410 nt, Artificial Sequence; identical to SEQ ID NO: 54372
  neuraminidase__InfluenzaA__AHL97964

SEQ ID NO: 55408 - RNA, 1410 nt, Artificial Sequence; identical to SEQ ID NO: 54444
  neuraminidase__InfluenzaA__AHL97976

SEQ ID NO: 55409 - RNA, 1410 nt, Artificial Sequence; identical to SEQ ID NO: 54372
  neuraminidase__InfluenzaA__AHL97988

SEQ ID NO: 55410 - RNA, 1410 nt, Artificial Sequence
  neuraminidase__InfluenzaA__AHL98000
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaugagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaaagacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55411 - RNA, 1410 nt, Artificial Sequence
  neuraminidase__InfluenzaA__AHL98012
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagaaaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaguucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaaggugaucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55412 - RNA, 1410 nt, Artificial Sequence; identical to SEQ ID NO: 54387
  neuraminidase__InfluenzaA__AHL98048

SEQ ID NO: 55413 - RNA, 1410 nt, Artificial Sequence; identical to SEQ ID NO: 54387
  neuraminidase__InfluenzaA__AHL98060

SEQ ID NO: 55414 - RNA, 1410 nt, Artificial Sequence; identical to SEQ ID NO: 54387
  neuraminidase__InfluenzaA__AHL98072

SEQ ID NO: 55415 - RNA, 1410 nt, Artificial Sequence
  neuraminidase__InfluenzaA__AHL98084
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55416 - RNA, 1410 nt, Artificial Sequence; identical to SEQ ID NO: 54387
  neuraminidase__InfluenzaA__AHL98096

SEQ ID NO: 55417 - RNA, 1410 nt, Artificial Sequence
  neuraminidase__InfluenzaA__AHL98119
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauuccgguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55418 - RNA, 1410 nt, Artificial Sequence; identical to SEQ ID NO: 54372
  neuraminidase__InfluenzaA__AHL98131

SEQ ID NO: 55419 - RNA, 1410 nt, Artificial Sequence
  neuraminidase__InfluenzaA__AHL98143
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgacccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaaguguguauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaauguguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55420 - RNA, 1410 nt, Artificial Sequence
  neuraminidase__InfluenzaA__AHL98155
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacucuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55421 - RNA, 1410 nt, Artificial Sequence; identical to SEQ ID NO: 54372
  neuraminidase__InfluenzaA__AHL98167

SEQ ID NO: 55422 - RNA, 1410 nt, Artificial Sequence; identical to SEQ ID NO: 54372
  neuraminidase__InfluenzaA__AHL98179

SEQ ID NO: 55423 - RNA, 1410 nt, Artificial Sequence; identical to SEQ ID NO: 54449
  neuraminidase__InfluenzaA__AHL98191

SEQ ID NO: 55424 - RNA, 1410 nt, Artificial Sequence; identical to SEQ ID NO: 54387
  neuraminidase__InfluenzaA__AHL98215

SEQ ID NO: 55425 - RNA, 1410 nt, Artificial Sequence
  neuraminidase__InfluenzaA__AHL98227
augaauccaaaucaaaagauaauaacgauuggcucuguuucucucaccauuuccacaauaugcuucuucaugcaaauugccaucuugauaacuacuguaacauugcauuucaagcaauaugaguucaacucccccccaaacaaccaagugaugcugugugaaccaacaauaauagaaagaaacauaacagauauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55426 - RNA, 1410 nt, Artificial Sequence
  neuraminidase__InfluenzaA__AHL98239
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgcgauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuagauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 55427 - RNA, 1410 nt, Artificial Sequence; identical to SEQ ID NO: 54372
  neuraminidase__InfluenzaA__AHL98251

SEQ ID NO: 55428 - RNA, 1410 nt, Artificial Sequence; identical to SEQ ID NO: 55191
  neuraminidase__InfluenzaA__AHL98263

SEQ ID NO: 55429 - RNA, 1410 nt, Artificial Sequence; identical to SEQ ID NO: 54444
  neuraminidase__InfluenzaA__AHL98275

SEQ ID NO: 55430 - RNA, 1410 nt, Artificial Sequence; identical to SEQ ID NO: 55296
  neuraminidase__InfluenzaA__AHL98287

SEQ ID NO: 55431 - RNA, 1410 nt, Artificial Sequence
  neuraminidase__InfluenzaA__AHL98298
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauaggaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccggcuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55432 - RNA, 1410 nt, Artificial Sequence; identical to SEQ ID NO: 54372
  neuraminidase__InfluenzaA__AHL98310

SEQ ID NO: 55433 - RNA, 1410 nt, Artificial Sequence; identical to SEQ ID NO: 54372
  neuraminidase__InfluenzaA__AHL98322

SEQ ID NO: 55434 - RNA, 1410 nt, Artificial Sequence
  neuraminidase__InfluenzaA__AHL98334
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagaggugguguaucugaccaacaccaccauagagaaggaaauaugccccaaaccagcagaauauagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55435 - RNA, 1410 nt, Artificial Sequence
  neuraminidase__InfluenzaA__AHL98346
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaaaugaagucuuguggaccucaaacaguauuguuguguuuuguggcaccucagguacauauggaacaggcucauggccugauggggcggaccucaaccucaugccuauauaa

SEQ ID NO: 55436 - RNA, 1410 nt, Artificial Sequence; identical to SEQ ID NO: 54372
  neuraminidase__InfluenzaA__AHL98357

SEQ ID NO: 55437 - RNA, 1410 nt, Artificial Sequence
  neuraminidase__InfluenzaA__AHL98369
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuucagcugguggggacaucugggugacaagagaaccuuaugugucaugcgguccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55438 - RNA, 1410 nt, Artificial Sequence
  neuraminidase__InfluenzaA__AHL98381
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguauauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgguccugacaaguguuaucaauuugcccuuggacagggaacaacacuaaacaacaugcauucaaauaacacaguacgugauaggaccccuuaucggacucuauugaugagugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauuaucaggaagugcucagcaugucgaagagugcucuugcuauccucgauauccuggugucagaugugucugcagagacaacuggaaaggcuccaaucggcccaucguagauauaaacauaaaggaucauagcacugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55439 - RNA, 1410 nt, Artificial Sequence
  neuraminidase__InfluenzaA__AHL98393
augaauccaaaucaaaagauaauaacgauuggcucuguuucucucaccauuuccacaauaugcuucuucaugcaaauugccauccugauaacuaccguaacauugcauuucaagcaauaugaauucaacucccccccaaacaaccaaaugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgguccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugaucagcauaucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55440 - RNA, 1410 nt, Artificial Sequence; identical to SEQ ID NO: 54449
  neuraminidase__InfluenzaA__AHL98405

SEQ ID NO: 55441 - RNA, 1410 nt, Artificial Sequence
  neuraminidase__InfluenzaA__AHL98417
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaacggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucuccguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55442 - RNA, 1410 nt, Artificial Sequence
  neuraminidase__InfluenzaA__AHL98429
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucagaacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcacuucagguacauauggaacaggcucauggccugauggggcggaccucaaucucaugccuauauaa

SEQ ID NO: 55443 - RNA, 1410 nt, Artificial Sequence
  neuraminidase__InfluenzaA__AHL98452
augaauccaacccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccguaaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacacuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucaaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaauuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55444 - RNA, 1410 nt, Artificial Sequence
  neuraminidase__InfluenzaA__AHL98474
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucggugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccaaacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55445 - RNA, 1410 nt, Artificial Sequence
  neuraminidase__InfluenzaA__AHL98485
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcauauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55446 - RNA, 1410 nt, Artificial Sequence; identical to SEQ ID NO: 54468
  neuraminidase__InfluenzaA__AHL98497

SEQ ID NO: 55447 - RNA, 1410 nt, Artificial Sequence; identical to SEQ ID NO: 54361
  neuraminidase__InfluenzaA__AHL98509

SEQ ID NO: 55448 - RNA, 1410 nt, Artificial Sequence; identical to SEQ ID NO: 54357
  neuraminidase__InfluenzaA__AHL98521

SEQ ID NO: 55449 - RNA, 1410 nt, Artificial Sequence; identical to SEQ ID NO: 54468
  neuraminidase__InfluenzaA__AHL98533

SEQ ID NO: 55450 - RNA, 1410 nt, Artificial Sequence; identical to SEQ ID NO: 54361
  neuraminidase__InfluenzaA__AHL98545

SEQ ID NO: 55451 - RNA, 1410 nt, Artificial Sequence; identical to SEQ ID NO: 54361
  neuraminidase__InfluenzaA__AHL98557

SEQ ID NO: 55452 - RNA, 1410 nt, Artificial Sequence; identical to SEQ ID NO: 54372
  neuraminidase__InfluenzaA__AHL98569

SEQ ID NO: 55453 - RNA, 1410 nt, Artificial Sequence
  neuraminidase__InfluenzaA__AHL98581
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauauagaaauuggucaaaaccgcaauguggcauuacaggauuugcaccuuucucuaaggacaauucgauuaggcuuuccgcuggugggaacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55454 - RNA, 1410 nt, Artificial Sequence; identical to SEQ ID NO: 54357
  neuraminidase__InfluenzaA__AHL98593

SEQ ID NO: 55455 - RNA, 1410 nt, Artificial Sequence; identical to SEQ ID NO: 54436
  neuraminidase__InfluenzaA__AHL98605

SEQ ID NO: 55456 - RNA, 1410 nt, Artificial Sequence; identical to SEQ ID NO: 54468
  neuraminidase__InfluenzaA__AHL98617

SEQ ID NO: 55457 - RNA, 1410 nt, Artificial Sequence; identical to SEQ ID NO: 54468
  neuraminidase__InfluenzaA__AHL98629

SEQ ID NO: 55458 - RNA, 1410 nt, Artificial Sequence
  neuraminidase__InfluenzaA__AHL98641
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucgugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugaugggaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55459 - RNA, 1410 nt, Artificial Sequence
  neuraminidase__InfluenzaA__AHL98653
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacaucuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuauggaccucaaacaguauuguuguguuuuguggcaccucagguacauauggaacaggcucauggccugauggggcggaccucaaucucaugccuauauaa

SEQ ID NO: 55460 - RNA, 1410 nt, Artificial Sequence
  neuraminidase__InfluenzaA__AHL98665
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucaggugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucugguacauauggaacaggcucauggccugauggggcggaccucaaucucaugccuauauaa

SEQ ID NO: 55461 - RNA, 1410 nt, Artificial Sequence
  neuraminidase__InfluenzaA__AHL98677
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccucaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaaaugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55462 - RNA, 1410 nt, Artificial Sequence
  neuraminidase__InfluenzaA__AHL98689
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgguccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacaucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55463 - RNA, 1410 nt, Artificial Sequence
  neuraminidase__InfluenzaA__AHL98702
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgggcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacaguuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 55464 - RNA, 1410 nt, Artificial Sequence; identical to SEQ ID NO: 54305
  neuraminidase__InfluenzaA__AHL98714

SEQ ID NO: 55465 - RNA, 1410 nt, Artificial Sequence
  neuraminidase__InfluenzaA__AHL98725
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcuggugggggcaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaaaugcuucaggaaaagcugauacuaaaauacuauucauugaggaggggaaaaucguucauacuagcacauugucaggaagugcucagcaugucgaagagugcucuugcuauccucgauauccuggugucagauguguuugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugaugaaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55466 - RNA, 1410 nt, Artificial Sequence
  neuraminidase__InfluenzaA__AHL98737
augaauccaaaucaaaagauaauaacgauuggcucuguuucucucaccauuuccacaauaugcuucuucaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauauagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55467 - RNA, 1410 nt, Artificial Sequence; identical to SEQ ID NO: 54375
  neuraminidase__InfluenzaA__AHL98749

SEQ ID NO: 55468 - RNA, 1410 nt, Artificial Sequence; identical to SEQ ID NO: 55466
  neuraminidase__InfluenzaA__AHL98761

SEQ ID NO: 55469 - RNA, 1410 nt, Artificial Sequence
  neuraminidase__InfluenzaA__AHL98773
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcuggugggaacaucugggugacaagagaaccuuaugugucaugcgauccugacaagugcuaucaauuugcccuuggacagggaacaacacuaaacaacgugcauucaaauaacacagcacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55470 - RNA, 1410 nt, Artificial Sequence; identical to SEQ ID NO: 54407
  neuraminidase__InfluenzaA__AHL98785

SEQ ID NO: 55471 - RNA, 1410 nt, Artificial Sequence
  neuraminidase__InfluenzaA__AHL98797
augaauccaaaucaaaagauaauaacgauuggcucuguuucucucaccauuuccacaauaugcuucuucacgcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccaucgagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcucaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55472 - RNA, 1410 nt, Artificial Sequence; identical to SEQ ID NO: 54369
  neuraminidase__InfluenzaA__AHL98809

SEQ ID NO: 55473 - RNA, 1410 nt, Artificial Sequence
  neuraminidase__InfluenzaA__AHL98821
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacagguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55474 - RNA, 1410 nt, Artificial Sequence; identical to SEQ ID NO: 54372
  neuraminidase__InfluenzaA__AHL98833

SEQ ID NO: 55475 - RNA, 1410 nt, Artificial Sequence
  neuraminidase__InfluenzaA__AHL98845
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaucaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgguccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55476 - RNA, 1410 nt, Artificial Sequence
  neuraminidase__InfluenzaA__AHL98857
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaagacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuugcacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55477 - RNA, 1410 nt, Artificial Sequence; identical to SEQ ID NO: 54387
  neuraminidase__InfluenzaA__AHL98869

SEQ ID NO: 55478 - RNA, 1410 nt, Artificial Sequence; identical to SEQ ID NO: 54414
  neuraminidase__InfluenzaA__AHL98881

SEQ ID NO: 55479 - RNA, 1410 nt, Artificial Sequence
  neuraminidase__InfluenzaA__AHL98893
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucuuugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 55480 - RNA, 1410 nt, Artificial Sequence; identical to SEQ ID NO: 54375
  neuraminidase__InfluenzaA__AHL98905

SEQ ID NO: 55481 - RNA, 1410 nt, Artificial Sequence; identical to SEQ ID NO: 54372
  neuraminidase__InfluenzaA__AHL98916

SEQ ID NO: 55482 - RNA, 1410 nt, Artificial Sequence; identical to SEQ ID NO: 55191
  neuraminidase__InfluenzaA__AHL98928

SEQ ID NO: 55483 - RNA, 1410 nt, Artificial Sequence; identical to SEQ ID NO: 55192
  neuraminidase__InfluenzaA__AHL98940

SEQ ID NO: 55484 - RNA, 1410 nt, Artificial Sequence
  neuraminidase__InfluenzaA__AHL98952
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaauuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 55485 - RNA, 1410 nt, Artificial Sequence
  neuraminidase__InfluenzaA__AHL98964
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggaucccaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 55486 - RNA, 1410 nt, Artificial Sequence
  neuraminidase__InfluenzaA__AHL98976
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaguagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuucugcugguggggacaucugggugacaagagaaccuuaugugucaugugauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggagacuuguagauaguguugcuucaugguccaaagaaguucucaggacccaggagucagaaugcguuuguaucaauggaacuugugcaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagacauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacaucacgcuuaggguaugaaaccuucaaaguuauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55487 - RNA, 1410 nt, Artificial Sequence; identical to SEQ ID NO: 54375
  neuraminidase__InfluenzaA__AHL98988

SEQ ID NO: 55488 - RNA, 1410 nt, Artificial Sequence; identical to SEQ ID NO: 54361
  neuraminidase__InfluenzaA__AHL99000

SEQ ID NO: 55489 - RNA, 1410 nt, Artificial Sequence
  neuraminidase__InfluenzaA__AHL99012
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuugggcagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55490 - RNA, 1410 nt, Artificial Sequence
  neuraminidase__InfluenzaA__AHL99024
augaauccaaaucaaaagauaauaacgauuggcucuguuucucucaccauuuccacaauaugcuucuucaugcaaauugccaucuugauaacuacuguaacauugcauuucaagcaauaugaauucaacucccccccgaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauacccuggugucagauguaucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55491 - RNA, 1410 nt, Artificial Sequence
  neuraminidase__InfluenzaA__AHL99036
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaggauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgaaacgucacgcuuaggguaugaaaccuucaaagucauugaaggcuggucuaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55492 - RNA, 1410 nt, Artificial Sequence
  neuraminidase__InfluenzaA__AHL99048
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucaggugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggguccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55493 - RNA, 1410 nt, Artificial Sequence
  neuraminidase__InfluenzaA__AHL99060
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucugggaaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55494 - RNA, 1410 nt, Artificial Sequence
  neuraminidase__InfluenzaA__AHL99072
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauauagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggccuauuguagauauaaacaugaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55495 - RNA, 1410 nt, Artificial Sequence
  neuraminidase__InfluenzaA__AHL99084
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacagguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauaacauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55496 - RNA, 1410 nt, Artificial Sequence; identical to SEQ ID NO: 54414
  neuraminidase__InfluenzaA__AHL99096

SEQ ID NO: 55497 - RNA, 1410 nt, Artificial Sequence; identical to SEQ ID NO: 54449
  neuraminidase__InfluenzaA__AHL99108

SEQ ID NO: 55498 - RNA, 1410 nt, Artificial Sequence
  neuraminidase__InfluenzaA__AHL99120
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacguauggaacaggcucauggccugauggggcggaccucaaucucaugccuauauaa

SEQ ID NO: 55499 - RNA, 1410 nt, Artificial Sequence; identical to SEQ ID NO: 54449
  neuraminidase__InfluenzaA__AHL99132

SEQ ID NO: 55500 - RNA, 1410 nt, Artificial Sequence
  neuraminidase__InfluenzaA__AHL99144
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauagaaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggagaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucagggcuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55501 - RNA, 1410 nt, Artificial Sequence; identical to SEQ ID NO: 54372
  neuraminidase__InfluenzaA__AHL99156

SEQ ID NO: 55502 - RNA, 1410 nt, Artificial Sequence
  neuraminidase__InfluenzaA__AHL99168
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacacaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55503 - RNA, 1410 nt, Artificial Sequence
  neuraminidase__InfluenzaA__AHL99180
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaccggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55504 - RNA, 1410 nt, Artificial Sequence
  neuraminidase__InfluenzaA__AHL99204
augaauccaaaucaaaaaauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaauuggaaaggcuccaaucggcccaucguagauauaaacauaaaggaucauagcauuguuuccaguuauguguguucaggacuuguuggagacacacccagaaaaaccgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggugcggaccucaaucucaugccuauauaa

SEQ ID NO: 55505 - RNA, 1410 nt, Artificial Sequence
  neuraminidase__InfluenzaA__AHL99216
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccguagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucauagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaaaaggaaacugaagucuuguggaccucaaacaguauuguuguguuuuguggcaccucagguacauauggaacaggcucauggccugauggggcggaccucaaucucaugccuauauaa

SEQ ID NO: 55506 - RNA, 1410 nt, Artificial Sequence; identical to SEQ ID NO: 54361
  neuraminidase__InfluenzaA__AHL99228

SEQ ID NO: 55507 - RNA, 1410 nt, Artificial Sequence
  neuraminidase__InfluenzaA__AHL99240
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaagggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucacagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55508 - RNA, 1410 nt, Artificial Sequence
  neuraminidase__InfluenzaA__AHL99252
augaauccaaaucaaaagauaauaacgauuggcucuguuucucucaccauuuccacaauaugcuucuucaugcaaauugcuaucuugauaacuacuguaacauugcauuucaagcaauaugaauucaacucccccccgaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauacccugguguuagaugugucugcagagacaacuggaaaggcuccaaucggcccaucguagauauaaacauaaaggaucauagcauuguuuccaguuauguauguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauaggucagguuauucugguauuuucucuguugaaggcaaaagcugcaucaaucggugcuuuuauguggaguugauuaggggaagaaaagaggaaacugaaguccuguggaccucaaacaguauuguuguguuuuguggcaccucagguacauauggaacaggcucauggccugauggggcggaccucaaucucaugccuauauaa

SEQ ID NO: 55509 - RNA, 1410 nt, Artificial Sequence
  neuraminidase__InfluenzaA__AHL99264
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucgugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55510 - RNA, 1410 nt, Artificial Sequence; identical to SEQ ID NO: 55192
  neuraminidase__InfluenzaA__AHL99276

SEQ ID NO: 55511 - RNA, 1410 nt, Artificial Sequence
  neuraminidase__InfluenzaA__AHL99288
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgaaacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55512 - RNA, 1410 nt, Artificial Sequence; identical to SEQ ID NO: 55377
  neuraminidase__InfluenzaA__AHL99300

SEQ ID NO: 55513 - RNA, 1410 nt, Artificial Sequence
  neuraminidase__InfluenzaA__AHL99312
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugcccuaaaccagcagaauacagaaauuggucaaaaccgcaaugugguauuacaggauuugcaccuuucucuaaggacaauucgauuaggcuuuccgcugguggggacaucuggguaacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55514 - RNA, 1410 nt, Artificial Sequence
  neuraminidase__InfluenzaA__AHL99324
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugauucugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucgaguugucacgauggaaaagcauggcugcauguuuguauaacgggggaugauaaaaaugcaacugcuagcuuuauuuacaaugggaagcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauauucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55515 - RNA, 1410 nt, Artificial Sequence; identical to SEQ ID NO: 54305
  neuraminidase__InfluenzaA__AHL99348

SEQ ID NO: 55516 - RNA, 1410 nt, Artificial Sequence
  neuraminidase__InfluenzaA__AHL99359
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggcgacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55517 - RNA, 1410 nt, Artificial Sequence
  neuraminidase__InfluenzaA__AHL99370
augaauccaaaucaaaagauaauaacgauuggcucuguuucucucaccauuaccacaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagaaugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggagcggaccucaaucucaugccuauauaa

SEQ ID NO: 55518 - RNA, 1410 nt, Artificial Sequence; identical to SEQ ID NO: 54449
  neuraminidase__InfluenzaA__AHL99393

SEQ ID NO: 55519 - RNA, 1410 nt, Artificial Sequence
  neuraminidase__InfluenzaA__AHL99417
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55520 - RNA, 1410 nt, Artificial Sequence; identical to SEQ ID NO: 55519
  neuraminidase__InfluenzaA__AHL99429

SEQ ID NO: 55521 - RNA, 1410 nt, Artificial Sequence
  neuraminidase__InfluenzaA__AHL99441
augaauccaaaucaaaaaauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaauuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggugcggaccucaaucucaugccuauauaa

SEQ ID NO: 55522 - RNA, 1410 nt, Artificial Sequence; identical to SEQ ID NO: 54361
  neuraminidase__InfluenzaA__AHL99453

SEQ ID NO: 55523 - RNA, 1410 nt, Artificial Sequence
  neuraminidase__InfluenzaA__AHL99477
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55524 - RNA, 1410 nt, Artificial Sequence; identical to SEQ ID NO: 55377
  neuraminidase__InfluenzaA__AHL99489

SEQ ID NO: 55525 - RNA, 1410 nt, Artificial Sequence
  neuraminidase__InfluenzaA__AHL99501
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcacuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55526 - RNA, 1410 nt, Artificial Sequence
  neuraminidase__InfluenzaA__AHL99525
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcaaauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55527 - RNA, 1410 nt, Artificial Sequence
  neuraminidase__InfluenzaA__AHL99537
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccucuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuaguuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaauugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55528 - RNA, 1410 nt, Artificial Sequence
  neuraminidase__InfluenzaA__AHL99549
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauuaucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuagaggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55529 - RNA, 1410 nt, Artificial Sequence; identical to SEQ ID NO: 54449
  neuraminidase__InfluenzaA__AHL99561

SEQ ID NO: 55530 - RNA, 1410 nt, Artificial Sequence
  neuraminidase__InfluenzaA__AHL99573
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccggagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucauagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacaaaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55531 - RNA, 1410 nt, Artificial Sequence
  neuraminidase__InfluenzaA__AHL99585
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacagcacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuugaauccuaacaaugaagaagguggucauggagugaaaggcugggccuuugaugauggaaaugacguauggaugggaagaacaaucaacgagacaucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55532 - RNA, 1410 nt, Artificial Sequence
  neuraminidase__InfluenzaA__AHL99597
augaauccaaaccaaaagauaauaaccauugguucggucuguaugacaauuggaauggcuaacuuaauauuacaaauuggaaacauaaucucaauauggauuagccacucaauucaaguugggaaucaaagucagauugaaacaugcaaucaaagcgucauuacuuaugaaaacaacacuuggguaaaucagacauauguuaacaucagcaacaccaacuuugcuguugggcagucaguggucuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaacggcauaauaacagacacuaucaagaguuggagaaacgauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 55533 - RNA, 1410 nt, Artificial Sequence
  neuraminidase__InfluenzaA__AHL99608
augaauccaaaucaaaagauaauaacgauuggcucuguuucucucaccauuuccacaauaugcgucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55534 - RNA, 1410 nt, Artificial Sequence
  neuraminidase__InfluenzaA__AHL99620
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaauguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucgaguugucacgauggaaaagcauggcugcauguuuguauaacgggggaugauaaaaaugcaacugcuagcuuuauuuacaaugggaagcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55535 - RNA, 1410 nt, Artificial Sequence
  neuraminidase__InfluenzaA__AHL99632
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaacaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuauggaccucaaacaguauuguuguguuuuguggcaccucagguacauauggaacaggcucauggccugauggggcggaccucaaucucaugccuauauaa

SEQ ID NO: 55536 - RNA, 1410 nt, Artificial Sequence
  neuraminidase__InfluenzaA__AHL99644
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaguagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuucugcugguggggacaucugggugacaagagaaccuuaugugucaugugauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggagacuuguagauaguguuguuucaugguccaaagaaguucucaggacccaggagucagaaugcguuuguaucaauggaacuugugcaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaaguuauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55537 - RNA, 1410 nt, Artificial Sequence
  neuraminidase__InfluenzaA__AHL99668
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccguagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucauagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55538 - RNA, 1410 nt, Artificial Sequence; identical to SEQ ID NO: 54414
  neuraminidase__InfluenzaA__AHL99680

SEQ ID NO: 55539 - RNA, 1410 nt, Artificial Sequence
  neuraminidase__InfluenzaA__AHL99692
augaauccaaaucaaaagauaauaacgauuggcucuguuucucucaccauuuccacaacaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55540 - RNA, 1410 nt, Artificial Sequence; identical to SEQ ID NO: 54372
  neuraminidase__InfluenzaA__AHL99704

SEQ ID NO: 55541 - RNA, 1410 nt, Artificial Sequence; identical to SEQ ID NO: 55503
  neuraminidase__InfluenzaA__AHL99716

SEQ ID NO: 55542 - RNA, 1410 nt, Artificial Sequence
  neuraminidase__InfluenzaA__AHL99740
augaauccaaaccaaaagauaauaaccauugguucggucuguaugacaauuggaauggcuaacuuaauauuacaaauuggaaacauaaucucaauauggauuagccacucaauucaaguugggaaucaaagucagauugaaacaugcaaucaaagcgucauuacuuaugaaaacaacacuuggguaaaucagacauauguuaacaucagcaacaccaacuuugcuguugggcagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaacggcauaauaacagacacuaucaagaguuggagaaacgauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccaugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 55543 - RNA, 1410 nt, Artificial Sequence
  neuraminidase__InfluenzaA__AHL99751
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccguagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaauguuaucaauuugcccuuggacagggaacaacacuaaacaacgugcauucaaauaacacagcacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuugaauccuaacaaugaagaagguggucauggagugaaaggcugggccuuugaugauggaaaugacguauggaugggaagaacaaucaacgagacaucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55544 - RNA, 1410 nt, Artificial Sequence
  neuraminidase__InfluenzaA__AHL99763
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagaugaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55545 - RNA, 1410 nt, Artificial Sequence
  neuraminidase__InfluenzaA__AHL99775
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacaggggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55546 - RNA, 1410 nt, Artificial Sequence
  neuraminidase__InfluenzaA__AHL99787
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugacacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccugaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55547 - RNA, 1410 nt, Artificial Sequence
  neuraminidase__InfluenzaA__AHL99799
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggacuaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagauguaucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggguccuaacaaugaagaagguggucauggagugaaaggcugggccuuugaugauggaaaugacguguggaugggaagaacaaucaacgagacgucacgcuuaggguaugaaacauucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55548 - RNA, 1410 nt, Artificial Sequence; identical to SEQ ID NO: 54414
  neuraminidase__InfluenzaA__AHL99811

SEQ ID NO: 55549 - RNA, 1410 nt, Artificial Sequence
  neuraminidase__InfluenzaA__AHL99823
augaauccaaaucaaaagauaauaacgauugguucuguuucucucaccauuuccacaauaugcuucuucaugcaaauugccaucuugauaacuacuguaacauugcacuucaagcaauaugaguucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugccacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuugugcaguaguaaugacugauggaagugcuucaggaaaagcugauacuaaaauacuauucauugaggaggggaaaaucguucauacuagcacauuaucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55550 - RNA, 1410 nt, Artificial Sequence
  neuraminidase__InfluenzaA__AHL99835
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgcuccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcugauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55551 - RNA, 1410 nt, Artificial Sequence
  neuraminidase__InfluenzaA__AHL99847
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguucccuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggggugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55552 - RNA, 1410 nt, Artificial Sequence; identical to SEQ ID NO: 54468
  neuraminidase__InfluenzaA__AHL99859

SEQ ID NO: 55553 - RNA, 1410 nt, Artificial Sequence
  neuraminidase__InfluenzaA__AHL99871
augaauccaaaucaaaagauaauaacgauuggcucuguuucucucaccauuuccacaauaugcuucuucaugcaaauugccaucuugacaacuacuguaacauugcauuucaagcaauaugaauucaauucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggaaucagaaugcguuuguaucaauggaacuuguacaguaguaaugacugaugggagugcuucaggaaaagcugauacuaaaauacuauucauugaggaggggagaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcucaagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55554 - RNA, 1410 nt, Artificial Sequence
  neuraminidase__InfluenzaA__AHL99883
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucuaacaguauuguuguguuuuguggcaccucagguacauauggaacaggcucauggccugauggggcggaccucaaucucaugccuauauaa

SEQ ID NO: 55555 - RNA, 1410 nt, Artificial Sequence
  neuraminidase__InfluenzaA__AHL99895
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacagcacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucacacuagcacauugucaggaagugcucagcaugucgaagagugcucuugcuauccucgauauccuggugucagaugugucugcagagacaacuggaaagguuccaaucggcccaucguagauauaaacauaaaggaucauagcauuguuuccaguuauguguguucaggacuuguuggagacacacccagaaaaaacgacagcuccagcaguagccauuguuugaauccuaacaaugaagaagguggucauggagugaaaggcugggccuuugaugauggaaaugacguauggaugggaagaacaaucaacgagacaucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 55556 - RNA, 1410 nt, Artificial Sequence
  neuraminidase__InfluenzaA__AHL99907
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55557 - RNA, 1410 nt, Artificial Sequence; identical to SEQ ID NO: 54372
  neuraminidase__InfluenzaA__AHL99919

SEQ ID NO: 55558 - RNA, 1410 nt, Artificial Sequence
  neuraminidase__InfluenzaA__AHL99943
augaauccaaaucaaaagauaauaacgauuggcucuguuucucucaccauuuccacaauaugcuucuucaugcaaauugccaucuugauaacuacuguaacauugcauuucaagcaacaugaauucaacucccccccaaacaaccaagugaugcugugugaaccaacaauaauagaaagaaacauaacagagauaguguaucugaccaacaccaccauagagaaagaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55559 - RNA, 1410 nt, Artificial Sequence; identical to SEQ ID NO: 54414
  neuraminidase__InfluenzaA__AHL99955

SEQ ID NO: 55560 - RNA, 1410 nt, Artificial Sequence
  neuraminidase__InfluenzaA__AHL99967
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacaugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacaugaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55561 - RNA, 1410 nt, Artificial Sequence
  neuraminidase__InfluenzaA__AHL99979
augaauccaaaucaaaagauaauaacgauuggcucuguuucucucaccauuuccacaauaugcuucuucaugcaaauugccaucuugauaacuacuguagcauugcauuucaagcaacaugaauucaacucccccccaaacaaucaagugaugcugugugaaccaacaauaauagaaagaaacauaacagagauaguguaucugaccaacaccaccauagagaaagaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggauggggagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55562 - RNA, 1410 nt, Artificial Sequence
  neuraminidase__InfluenzaA__AHL99991
augaauccaaaucaaaagauaauaacgauuggcucuguuucucucaccauuuccacaauaugcuucuucaugcaaauugccaucuugauaacuacuguaacauugcauuucaagcaacaugaauucaacucccccccaaacaaucaagugaugcugugugaaccaacaauaauagaaagaaacauaacagagauaguguaucugaccaacaccaccauagagaaagaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggauggggagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55563 - RNA, 1410 nt, Artificial Sequence; identical to SEQ ID NO: 54449
  neuraminidase__InfluenzaA__AHM00004

SEQ ID NO: 55564 - RNA, 1410 nt, Artificial Sequence; identical to SEQ ID NO: 54414
  neuraminidase__InfluenzaA__AHM00016

SEQ ID NO: 55565 - RNA, 1410 nt, Artificial Sequence; identical to SEQ ID NO: 54372
  neuraminidase__InfluenzaA__AHM00028

SEQ ID NO: 55566 - RNA, 1410 nt, Artificial Sequence
  neuraminidase__InfluenzaA__AHM00040
augaauccaaaucaaaagauaauaacgauuggcucuguuucucucaccauuuccacaauaugcuucuucaugcaaauugccaucuugauaacuacuguaacauugcauuucaagcaacaugaauucaacucccccccaaacaaucaagugaugcugugugaaccaacaauaauagaaagaaacauaacagagauaguguaucugaccaacaccaccauagagaaagaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55567 - RNA, 1410 nt, Artificial Sequence; identical to SEQ ID NO: 55415
  neuraminidase__InfluenzaA__AHM00052

SEQ ID NO: 55568 - RNA, 1410 nt, Artificial Sequence
  neuraminidase__InfluenzaA__AHM00064
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaccgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55569 - RNA, 1410 nt, Artificial Sequence; identical to SEQ ID NO: 54414
  neuraminidase__InfluenzaA__AHM00076

SEQ ID NO: 55570 - RNA, 1410 nt, Artificial Sequence; identical to SEQ ID NO: 54414
  neuraminidase__InfluenzaA__AHM00088

SEQ ID NO: 55571 - RNA, 1410 nt, Artificial Sequence
  neuraminidase__InfluenzaA__AHM00100
augaauccaaaccaaaagauaauaaccauugguucgaucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcagcuggacagucagugguuucugugaaauuagcgggcaauuccucucucugcccuguuagugggugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucaugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaacaaagcaagauaucguaggaauaaaugaguggucaggauauagcgggaguuuuguucagcauccagaacuaacagggcuggauuguauaagaccuugcuucuggguugaacuaaucagagggagacccaaagagaacacaaucuggacuagcgggagcagcauauccuuuugugguguaaacagugacacuguggguuggucuuggccagacggugcugaguugccauuuaccauugacaauuaa

SEQ ID NO: 55572 - RNA, 1410 nt, Artificial Sequence
  neuraminidase__InfluenzaA__AHM00111
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacaugaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55573 - RNA, 1410 nt, Artificial Sequence; identical to SEQ ID NO: 55566
  neuraminidase__InfluenzaA__AHM00123

SEQ ID NO: 55574 - RNA, 1410 nt, Artificial Sequence
  neuraminidase__InfluenzaA__AHM00135
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55575 - RNA, 1410 nt, Artificial Sequence
  neuraminidase__InfluenzaA__AHM00147
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcgugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55576 - RNA, 1410 nt, Artificial Sequence; identical to SEQ ID NO: 55566
  neuraminidase__InfluenzaA__AHM00159

SEQ ID NO: 55577 - RNA, 1410 nt, Artificial Sequence; identical to SEQ ID NO: 54414
  neuraminidase__InfluenzaA__AHM00171

SEQ ID NO: 55578 - RNA, 1410 nt, Artificial Sequence; identical to SEQ ID NO: 54449
  neuraminidase__InfluenzaA__AHM00183

SEQ ID NO: 55579 - RNA, 1410 nt, Artificial Sequence
  neuraminidase__InfluenzaA__AHM00195
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccacuauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacaggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaguacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55580 - RNA, 1410 nt, Artificial Sequence
  neuraminidase__InfluenzaA__AHM00207
augaauccaaaucaaaagauaauaacgauuggcucuguuucucucaccauuuccacaauaugcuucuucaugcaaauugccaucuugauaacuacuguaacauugcauuucaagcaacaugaauucaacucccccccaaacaaccaagugaugcugugugaaccaacaauaauagaaagaaacauaacagagauaguguaucugaccaacaccaccauagagaaagaaauaugccccaaaccagcagaauacagaaauuggucaaaaccgcaauguggcauuacaggauuugcaccuuucucuaaggacaauucgauuaggcuuuccgcuggugggaacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaggucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55581 - RNA, 1410 nt, Artificial Sequence
  neuraminidase__InfluenzaA__AHM00219
augaauccaaaucaaaagauaauaacgauuggcucuguuucucucaccauuuccacaauaugcuucuucaugcaaauugccaucuugauaacuacuguaacauugcauuucaagcaacaugaauucaacucccccccaaacaaucaagugaugcugugugaaccaacaauaauagaaagaaacauaacagagauaguguaucugaccaacaccaccauagagaaagaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacaucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55582 - RNA, 1410 nt, Artificial Sequence; identical to SEQ ID NO: 54414
  neuraminidase__InfluenzaA__AHM00231

SEQ ID NO: 55583 - RNA, 1410 nt, Artificial Sequence; identical to SEQ ID NO: 54414
  neuraminidase__InfluenzaA__AHM00243

SEQ ID NO: 55584 - RNA, 1410 nt, Artificial Sequence; identical to SEQ ID NO: 54449
  neuraminidase__InfluenzaA__AHM00255

SEQ ID NO: 55585 - RNA, 1410 nt, Artificial Sequence
  neuraminidase__InfluenzaA__AHM00267
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguugcuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55586 - RNA, 1410 nt, Artificial Sequence
  neuraminidase__InfluenzaA__AHM00279
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgguauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55587 - RNA, 1410 nt, Artificial Sequence; identical to SEQ ID NO: 54449
  neuraminidase__InfluenzaA__AHM00291

SEQ ID NO: 55588 - RNA, 1410 nt, Artificial Sequence; identical to SEQ ID NO: 54414
  neuraminidase__InfluenzaA__AHM00303

SEQ ID NO: 55589 - RNA, 1410 nt, Artificial Sequence
  neuraminidase__InfluenzaA__AHM00315
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggggugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55590 - RNA, 1410 nt, Artificial Sequence; identical to SEQ ID NO: 55574
  neuraminidase__InfluenzaA__AHM00327

SEQ ID NO: 55591 - RNA, 1410 nt, Artificial Sequence; identical to SEQ ID NO: 55574
  neuraminidase__InfluenzaA__AHM00339

SEQ ID NO: 55592 - RNA, 1410 nt, Artificial Sequence; identical to SEQ ID NO: 55566
  neuraminidase__InfluenzaA__AHM00351

SEQ ID NO: 55593 - RNA, 1410 nt, Artificial Sequence; identical to SEQ ID NO: 55572
  neuraminidase__InfluenzaA__AHM00363

SEQ ID NO: 55594 - RNA, 1410 nt, Artificial Sequence
  neuraminidase__InfluenzaA__AHM00375
augaauccaaaucaaaagauaauaacgauuggcucuguuucucucaccauuuccacaauaugcuucuucaugcaaauugccaucuugauaacuacuguaacauugcauuucaagcaacaugaauucaacucccccccaaacaaucaagugaugcugugugaaccaacaauaauagaaagaaacauaacagagauaguguaucugaccaacaccaccauagagaaagaaguaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55595 - RNA, 1410 nt, Artificial Sequence
  neuraminidase__InfluenzaA__AHM00398
augaauccaaaucaaaagauaauaacgauuggcucuguuucucucaccauuuccacaauaugcuucuucaugcaaauugccaucuugauaacuacuguaacauugcauuucaagcaacaugaauucaacucccccccaaacaaucaagugaugcugugugaaccaacaauaauagaaagaaacauaacagagauaguguaucugaccaacaccaccauagagaaagaaauaugccccaaaccagcagaauacagaaauuggucaaaaccgcaauguggcauuacaggauuugcaccuuucucuaaggaaaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaagcaguauuguuguguuuuguggcaccucagguacauauggaacaggcucauggccugauggggcggaccucaaucucaugccuauauaa

SEQ ID NO: 55596 - RNA, 1410 nt, Artificial Sequence; identical to SEQ ID NO: 54449
  neuraminidase__InfluenzaA__AHM00410

SEQ ID NO: 55597 - RNA, 1410 nt, Artificial Sequence
  neuraminidase__InfluenzaA__AHM00422
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucaacaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugaugggaaugacguguggaugggaagaacaaucaacgaaacgucacgcuuaggguaugaaaccuucaaagucauugaaggcugguccaacccuaaguccaaauugcagauaaauaggcaagucauaguugacagaggugauagguccgguuauuccgguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55598 - RNA, 1410 nt, Artificial Sequence
  neuraminidase__InfluenzaA__AHM00434
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55599 - RNA, 1410 nt, Artificial Sequence; identical to SEQ ID NO: 54449
  neuraminidase__InfluenzaA__AHM00446

SEQ ID NO: 55600 - RNA, 1410 nt, Artificial Sequence; identical to SEQ ID NO: 55558
  neuraminidase__InfluenzaA__AHM00458

SEQ ID NO: 55601 - RNA, 1410 nt, Artificial Sequence
  neuraminidase__InfluenzaA__AHM00470
augaauccaaaucaaaagauaauaacgauuggcucuguuucucucaccauuuccacaauaugcuucuucaugcaaauugccauccugauaacuacuguaacauugcauuucaagcaacaugaauucaacucccccccaaacaaucaagugaugcugugugaaccaacaauaauagaaagaaacauaacagagauaguguaucugaccaacaccaccauagagaaagaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55602 - RNA, 1410 nt, Artificial Sequence; identical to SEQ ID NO: 55566
  neuraminidase__InfluenzaA__AHM00482

SEQ ID NO: 55603 - RNA, 1410 nt, Artificial Sequence; identical to SEQ ID NO: 55566
  neuraminidase__InfluenzaA__AHM00494

SEQ ID NO: 55604 - RNA, 1410 nt, Artificial Sequence
  neuraminidase__InfluenzaA__AHM00506
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguuaacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55605 - RNA, 1410 nt, Artificial Sequence
  neuraminidase__InfluenzaA__AHM00518
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55606 - RNA, 1410 nt, Artificial Sequence
  neuraminidase__InfluenzaA__AHM00530
augaauccaaaucaaaagauaauaacgauuggcucuguuucucucaccauuuccacaauaugcuucuccaugcaaauugccaucuugauaacuacuguaacauugcauuucaagcaauaugaauucaacccccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguauguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55607 - RNA, 1410 nt, Artificial Sequence; identical to SEQ ID NO: 55574
  neuraminidase__InfluenzaA__AHM00542

SEQ ID NO: 55608 - RNA, 1410 nt, Artificial Sequence
  neuraminidase__InfluenzaA__AHM00546
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccaaguauguguguucaggacuuguuggagacacacccagaaaaaacgacagcucaagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55609 - RNA, 1410 nt, Artificial Sequence
  neuraminidase__InfluenzaA__AHM00558
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaguaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55610 - RNA, 1410 nt, Artificial Sequence; identical to SEQ ID NO: 55415
  neuraminidase__InfluenzaA__AHM00570

SEQ ID NO: 55611 - RNA, 1410 nt, Artificial Sequence; identical to SEQ ID NO: 54414
  neuraminidase__InfluenzaA__AHM00582

SEQ ID NO: 55612 - RNA, 1410 nt, Artificial Sequence
  neuraminidase__InfluenzaA__AHM00594
augaauccaaaucaaaagauaauaacgauuggcucuguuucucucaccauuuccacaauaugcuucuucaugcaaauugccauccugauaacuacuguaacauugcauuucaagcaacaugaauucaacucccccccaaacaaucaagugaugcugugugaaccaacaauaauagaaagaaacauaacagagauagugcaucugaccaacaccaccauagagaaagaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55613 - RNA, 1410 nt, Artificial Sequence; identical to SEQ ID NO: 54414
  neuraminidase__InfluenzaA__AHM00606

SEQ ID NO: 55614 - RNA, 1410 nt, Artificial Sequence; identical to SEQ ID NO: 55605
  neuraminidase__InfluenzaA__AHM00618

SEQ ID NO: 55615 - RNA, 1410 nt, Artificial Sequence; identical to SEQ ID NO: 54414
  neuraminidase__InfluenzaA__AHM00630

SEQ ID NO: 55616 - RNA, 1410 nt, Artificial Sequence; identical to SEQ ID NO: 54414
  neuraminidase__InfluenzaA__AHM00642

SEQ ID NO: 55617 - RNA, 1410 nt, Artificial Sequence; identical to SEQ ID NO: 55574
  neuraminidase__InfluenzaA__AHM00654

SEQ ID NO: 55618 - RNA, 1410 nt, Artificial Sequence; identical to SEQ ID NO: 54361
  neuraminidase__InfluenzaA__AHM00666

SEQ ID NO: 55619 - RNA, 1410 nt, Artificial Sequence; identical to SEQ ID NO: 55601
  neuraminidase__InfluenzaA__AHM00678

SEQ ID NO: 55620 - RNA, 1410 nt, Artificial Sequence; identical to SEQ ID NO: 54305
  neuraminidase__InfluenzaA__AHM00690

SEQ ID NO: 55621 - RNA, 1410 nt, Artificial Sequence; identical to SEQ ID NO: 55586
  neuraminidase__InfluenzaA__AHM00701

SEQ ID NO: 55622 - RNA, 1410 nt, Artificial Sequence
  neuraminidase__InfluenzaA__AHM00713
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaucagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55623 - RNA, 1410 nt, Artificial Sequence; identical to SEQ ID NO: 54414
  neuraminidase__InfluenzaA__AHM00725

SEQ ID NO: 55624 - RNA, 1410 nt, Artificial Sequence; identical to SEQ ID NO: 54414
  neuraminidase__InfluenzaA__AHM00737

SEQ ID NO: 55625 - RNA, 1410 nt, Artificial Sequence; identical to SEQ ID NO: 55558
  neuraminidase__InfluenzaA__AHM00749

SEQ ID NO: 55626 - RNA, 1410 nt, Artificial Sequence
  neuraminidase__InfluenzaA__AHM00761
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauugguccaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55627 - RNA, 1410 nt, Artificial Sequence
  neuraminidase__InfluenzaA__AHM00785
augaauccaaaucaaaagauaauaacgauuggcucuguuucucucaccauuuccacaauaugcuucuucaugcaaauugccauccugauaaccacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgguauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55628 - RNA, 1410 nt, Artificial Sequence; identical to SEQ ID NO: 55568
  neuraminidase__InfluenzaA__AHM00797

SEQ ID NO: 55629 - RNA, 1410 nt, Artificial Sequence
  neuraminidase__InfluenzaA__AHM00809
augaauccaaaucaaaagauaauaacgauuggcucuguuucucucaccauuuccacaauaugcuucuucauacaaauugccaucuugauaacuacuguaacauugcauuucaagcaauaugaauucaacucccccccaaacaaccaaguaaugcugugugaaccaacaauaauagaaagaaacauaacagagauaguguaucugaccaacaccaccauagagaaggaaauaugucccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacaugcauucaaauaacacaguacgugauaggaccccuuaucggacccuauugaugaaugaguuggguguuccuuuucaucuggggaccaagcaagugugcauagcaugguccagcucaagcugucacgauggaaaagcauggcugcauguuuguauaacgggggaugauaaaaaugcaacugcuagcuucauuuacaauggaaggcuuguagauaguguuguuucaugguccaaagaaauccucaggacccaggagucagaaugcguuugcaucaauggaacuuguacaguaguaaugacugaugggagugcuucgggaaaagcugauacuaaaauacuauucauugaggaggggaaaaucguucauacuagcacauugucaggaagugcucagcaugucgaggagugcucuugcuauccucgauacccuggugucagaugugucugcagagacaacuggaaaggcuccaauaggcccaucguagauauaaacauaaaggaucauagcauuguuuccaguuauguguguucagggcuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggcgauagguccgguuauucugguauuuucucuguugaaggcaaaagcugcaucaaucggugcuuuuauguggaguugaucaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55630 - RNA, 1410 nt, Artificial Sequence; identical to SEQ ID NO: 55601
  neuraminidase__InfluenzaA__AHM00821

SEQ ID NO: 55631 - RNA, 1410 nt, Artificial Sequence; identical to SEQ ID NO: 55558
  neuraminidase__InfluenzaA__AHM00833

SEQ ID NO: 55632 - RNA, 1410 nt, Artificial Sequence; identical to SEQ ID NO: 55568
  neuraminidase__InfluenzaA__AHM00845

SEQ ID NO: 55633 - RNA, 1410 nt, Artificial Sequence; identical to SEQ ID NO: 55415
  neuraminidase__InfluenzaA__AHM00857

SEQ ID NO: 55634 - RNA, 1410 nt, Artificial Sequence; identical to SEQ ID NO: 55415
  neuraminidase__InfluenzaA__AHM00869

SEQ ID NO: 55635 - RNA, 1410 nt, Artificial Sequence; identical to SEQ ID NO: 54414
  neuraminidase__InfluenzaA__AHM00881

SEQ ID NO: 55636 - RNA, 1410 nt, Artificial Sequence; identical to SEQ ID NO: 54468
  neuraminidase__InfluenzaA__AHM00893

SEQ ID NO: 55637 - RNA, 1410 nt, Artificial Sequence
  neuraminidase__InfluenzaA__AHM00905
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaccgacagcuccagcaguggccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55638 - RNA, 1410 nt, Artificial Sequence
  neuraminidase__InfluenzaA__AHM00917
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacauauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55639 - RNA, 1410 nt, Artificial Sequence
  neuraminidase__InfluenzaA__AHM00929
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaauuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggcauuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55640 - RNA, 1410 nt, Artificial Sequence
  neuraminidase__InfluenzaA__AHM00941
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugauaaguguuaucaauuugcucuuggacagggaacaacacuaaacaacgugcauucaaauaacacaauacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55641 - RNA, 1410 nt, Artificial Sequence
  neuraminidase__InfluenzaA__AHM00953
augaauccaaaucaaaagauaauaacgauuggcucuguuucucucaccauuuccacaauaugcuucuucaugcaaauugccaucuugauaacuacuguaacauugcauuucaagcaauaugcauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55642 - RNA, 1410 nt, Artificial Sequence; identical to SEQ ID NO: 55574
  neuraminidase__InfluenzaA__AHM00965

SEQ ID NO: 55643 - RNA, 1410 nt, Artificial Sequence
  neuraminidase__InfluenzaA__AHM00977
augaauccaaaucaaaagauaauaacgauuggcucuguuucucucaccauuuccacaauaugcuucuucaugcaaauugccauccugauaaccacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgguauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55644 - RNA, 1398 nt, Artificial Sequence
  neuraminidase__InfluenzaA__AHM24226
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauguugaaaugggagucucugacuggaacugcuaagcauaaugaagaaugcucauguuacggggaacgaacaggaauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 55645 - RNA, 1398 nt, Artificial Sequence
  neuraminidase__InfluenzaA__AHM24238
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagauucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 55646 - RNA, 1398 nt, Artificial Sequence
  neuraminidase__InfluenzaA__AHM24250
augaauccaaaucagaagauucuaugcacuucagccacugcuaucauaauaggcgcaaucgcaguacucauuggaauagcaaaccuaggauugaacauaggacugcaucuaaaaccgagcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagaacucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacgguguaugcccaguaguguucaccgaugggucugccacuggaccugcagacacaagaauauacuauuuuaaagaggggaaaauauugaaaugggagucucugacuggaacugcuaagcauauugaagaaugcucguguuacggggaacgaacaggaauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 55647 - RNA, 1410 nt, Artificial Sequence
  neuraminidase__InfluenzaA__AHM98312
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaguaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55648 - RNA, 1410 nt, Artificial Sequence
  neuraminidase__InfluenzaA__AHM98331
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguacacagugacacuguggguuggucuuggccagacggugcugaguugccauuuaccauugacaaguaa

SEQ ID NO: 55649 - RNA, 1410 nt, Artificial Sequence
  neuraminidase__InfluenzaA__AHM98342
augaauccaaaccaaaagauaauaaccauugguucggucuguaugacaauuggaauggcuaacuuaauauuacaaauuggaaacauaaucucaauauggauuagccacucaauucaaauugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccugucaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55650 - RNA, 1410 nt, Artificial Sequence
  neuraminidase__InfluenzaA__AHM98353
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguagaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55651 - RNA, 1410 nt, Artificial Sequence
  neuraminidase__InfluenzaA__AHM98364
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaauuuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagauuuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55652 - RNA, 1410 nt, Artificial Sequence
  neuraminidase__InfluenzaA__AHM98375
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauuucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55653 - RNA, 1410 nt, Artificial Sequence
  neuraminidase__InfluenzaA__AHM98386
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucugucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55654 - RNA, 1410 nt, Artificial Sequence
  neuraminidase__InfluenzaA__AHM98408
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggauaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucaugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55655 - RNA, 1410 nt, Artificial Sequence; identical to SEQ ID NO: 55654
  neuraminidase__InfluenzaA__AHM98419

SEQ ID NO: 55656 - RNA, 1410 nt, Artificial Sequence
  neuraminidase__InfluenzaA__AHM98430
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaaacgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagcgggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55657 - RNA, 1410 nt, Artificial Sequence; identical to SEQ ID NO: 51461
  neuraminidase__InfluenzaA__AHM98441

SEQ ID NO: 55658 - RNA, 1410 nt, Artificial Sequence
  neuraminidase__InfluenzaA__AHM98452
augaauccaaaccaaaagauaauaaccauugguucggucuguaugacaauuggaauggcuaacuuaauauuacaaauuggaaacauaaucucaauauggauuagccacucaauucaacuuaggaaccaaagucagauugaaacaugcaaucaaagcgucauuacuuacgaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaguaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 55659 - RNA, 1410 nt, Artificial Sequence
  neuraminidase__InfluenzaA__AHM98474
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauuaagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuacuauugacaaguaa

SEQ ID NO: 55660 - RNA, 1410 nt, Artificial Sequence
  neuraminidase__InfluenzaA__AHM98485
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55661 - RNA, 1410 nt, Artificial Sequence
  neuraminidase__InfluenzaA__AHM98496
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguaucagaaucgguuccaagggggauguguuugucauaagggaaccauucauaucaugcucccccuuggaaugcagaaccuucuucuugacucaaggggcuuugcuaaaugacaaacauuccaauggaaccauuaaaaacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucaaaugugugugcagggauaacuggcauggcucgaaucgaccgugggugucuuucaaccagaaucuggaauaucagauaggauacauaugcaguggaauuuucggagacaauccacgcccuaaugauaagacaggcaguugugguccaguaucgucuaauggagcaaauggaguaaaaggauuuucauucaaauacggcaaugguguuuggauagggaggacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55662 - RNA, 1410 nt, Artificial Sequence; identical to SEQ ID NO: 51329
  neuraminidase__InfluenzaA__AHM98507

SEQ ID NO: 55663 - RNA, 1410 nt, Artificial Sequence
  neuraminidase__InfluenzaA__AHM98518
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggauaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucaugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauguccuuuugugguguaaacagugacacuguggguuggucuuggccagacggugcugaguugccauuuaccauugacaaguaa

SEQ ID NO: 55664 - RNA, 1410 nt, Artificial Sequence; identical to SEQ ID NO: 53906
  neuraminidase__InfluenzaA__AHM98529

SEQ ID NO: 55665 - RNA, 1410 nt, Artificial Sequence
  neuraminidase__InfluenzaA__AHM98540
augaauccaaaccaaaagauaauaaccauugguucggucuguauaacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucggacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacaaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugauugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaguacggcaaugguguuuggauagggagaacuaaaagcauuaguucaagaaaagguuuugagaugauuugggauccaaacggauggacugggacagacaauaacuucucaauaaagcaagauauuguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55666 - RNA, 1410 nt, Artificial Sequence
  neuraminidase__InfluenzaA__AHM98562
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaggcaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacaguuacacuguggguuggucuuggccagacggugcugaguugccauuuaccauugacaaguaa

SEQ ID NO: 55667 - RNA, 1410 nt, Artificial Sequence
  neuraminidase__InfluenzaA__AHM98573
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaaacgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagcgggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55668 - RNA, 1410 nt, Artificial Sequence
  neuraminidase__InfluenzaA__AHM98584
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggauaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggagaaguucccucuccauacaacucaagauuugagucagucgcuuggucagcaagugcuugucaugauggcaucaauuggcuaacaauuggaauuucuggcccagacaauggggcaguggcuguguuaagguacaacggcauaauaacagacacuaucaagaguuggagaaacaauauauugagaacacaagagucugaaugugcauguguaaaugguucaugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55669 - RNA, 1410 nt, Artificial Sequence
  neuraminidase__InfluenzaA__AHM98595
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaaacgucauuacuuaugaaaacaacacuuggguaaaucagacauauguuaacaucaguaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagcgggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55670 - RNA, 1410 nt, Artificial Sequence
  neuraminidase__InfluenzaA__AHM98606
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacgggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55671 - RNA, 1410 nt, Artificial Sequence
  neuraminidase__InfluenzaA__AHM98617
augaauccaaaccaaaagauaauaaccauugguucagucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggauaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuugggaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucaugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuuguggugugaacagugacacuguggguuggucuuggccagacggugcugaguugccauuuaccauugacaaguaa

SEQ ID NO: 55672 - RNA, 1410 nt, Artificial Sequence; identical to SEQ ID NO: 55654
  neuraminidase__InfluenzaA__AHM98628

SEQ ID NO: 55673 - RNA, 1410 nt, Artificial Sequence
  neuraminidase__InfluenzaA__AHM98639
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuauuuaugaaaacaacacuuggauaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucaugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55674 - RNA, 1410 nt, Artificial Sequence
  neuraminidase__InfluenzaA__AHM98650
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55675 - RNA, 1410 nt, Artificial Sequence; identical to SEQ ID NO: 51513
  neuraminidase__InfluenzaA__AHM98661

SEQ ID NO: 55676 - RNA, 1410 nt, Artificial Sequence
  neuraminidase__InfluenzaA__AHM98672
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaaacgucauuacuuaugaaaacaacacuuggguaaaucagacauauguuaacaucagcaacaccaacuuugcugcugaacagucagugguucccgugaaauuagcgggcaauuccucucucugcccuguuaguggaugggcuauauacaguaaggacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagcgggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55677 - RNA, 1410 nt, Artificial Sequence
  neuraminidase__InfluenzaA__AHM98683
augaauccaaaccaaaagauaauaaccauugguucggucuguaugacaauuggaauggcuaacuuaauauuacaaauuggaaacauaaucucaauauggauuagccacucaauucaacuugggaaucaaaaucaaauugaaacaugcaaucaaagcgucauuacuuaugaaaacaacacuuggguaaaucagacauauguuaacaucagcaacaccaacuuugaugccggacagucagugguuuccgugagauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcuucaauuggcuaacaauuggaauuucuggcccagacaauggggcaguggcuguguuaaaguauaacggcauaauaacagacacuaucaggaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauauauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55678 - RNA, 1410 nt, Artificial Sequence
  neuraminidase__InfluenzaA__AHM98693
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucaucacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugacugauggaccaagugauggacaagccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaaccaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55679 - RNA, 1410 nt, Artificial Sequence; identical to SEQ ID NO: 53663
  neuraminidase__InfluenzaA__AHM98704

SEQ ID NO: 55680 - RNA, 1410 nt, Artificial Sequence; identical to SEQ ID NO: 53663
  neuraminidase__InfluenzaA__AHM98715

SEQ ID NO: 55681 - RNA, 1410 nt, Artificial Sequence
  neuraminidase__InfluenzaA__AHM98726
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucaucacuuaugaaaacaacacuuggguaaaucaaacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauuuugagaacacaagagucugaaugugcauguguaaaugguucuugcuuuaccauaaugacugauggaccaagugauggacaagccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaaccaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55682 - RNA, 1410 nt, Artificial Sequence
  neuraminidase__InfluenzaA__AHM98737
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuaauuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucguaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaaugauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucaaaucgaccgugggugucuuucaaccagaaccuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 55683 - RNA, 1410 nt, Artificial Sequence
  neuraminidase__InfluenzaA__AHM98748
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucaucacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaggaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 55684 - RNA, 1410 nt, Artificial Sequence
  neuraminidase__InfluenzaA__AHM98759
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaauuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 55685 - RNA, 1410 nt, Artificial Sequence
  neuraminidase__InfluenzaA__AHM98770
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgccauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 55686 - RNA, 1410 nt, Artificial Sequence
  neuraminidase__InfluenzaA__AHM98781
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaccagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucaagugaaaucacaugugugugcagggauaacuggcauggcucgaaucgaccgugggugucuuucaaccagaaucuggaauaucagauaggauacauaugcagugggauuuucggagacaauccacgcccuagugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacaguggcacuguggguuggucuuggccagacggugcugaguugccauuuaccauugacaaguaa

SEQ ID NO: 55687 - RNA, 1410 nt, Artificial Sequence; identical to SEQ ID NO: 53812
  neuraminidase__InfluenzaA__AHM98801

SEQ ID NO: 55688 - RNA, 1410 nt, Artificial Sequence; identical to SEQ ID NO: 51098
  neuraminidase__InfluenzaA__AHM98812

SEQ ID NO: 55689 - RNA, 1410 nt, Artificial Sequence
  neuraminidase__InfluenzaA__AHM98823
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauauuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccucggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55690 - RNA, 1410 nt, Artificial Sequence
  neuraminidase__InfluenzaA__AHM98839
augaauccaaaccaaaagauaauaaccauugguucggucuguaugacaguuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55691 - RNA, 1410 nt, Artificial Sequence; identical to SEQ ID NO: 53773
  neuraminidase__InfluenzaA__AHM98850

SEQ ID NO: 55692 - RNA, 1410 nt, Artificial Sequence; identical to SEQ ID NO: 51098
  neuraminidase__InfluenzaA__AHM98861

SEQ ID NO: 55693 - RNA, 1410 nt, Artificial Sequence
  neuraminidase__InfluenzaA__AHM98901
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuuaugagcuguccuauuggugaaguucccucuccauacaacucaagauuugagucagucgcuuggucagcaagugcuugucaugauggcaucaauuggcuaacaauuggaauuucgggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55694 - RNA, 1410 nt, Artificial Sequence; identical to SEQ ID NO: 54350
  neuraminidase__InfluenzaA__AHM98912

SEQ ID NO: 55695 - RNA, 1410 nt, Artificial Sequence; identical to SEQ ID NO: 54350
  neuraminidase__InfluenzaA__AHM98923

SEQ ID NO: 55696 - RNA, 1410 nt, Artificial Sequence; identical to SEQ ID NO: 54350
  neuraminidase__InfluenzaA__AHM98935

SEQ ID NO: 55697 - RNA, 1410 nt, Artificial Sequence; identical to SEQ ID NO: 54350
  neuraminidase__InfluenzaA__AHM98943

SEQ ID NO: 55698 - RNA, 1410 nt, Artificial Sequence; identical to SEQ ID NO: 54350
  neuraminidase__InfluenzaA__AHM98954

SEQ ID NO: 55699 - RNA, 1410 nt, Artificial Sequence
  neuraminidase__InfluenzaA__AHM98972
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagagucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggcuacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagggggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55700 - RNA, 1410 nt, Artificial Sequence; identical to SEQ ID NO: 55699
  neuraminidase__InfluenzaA__AHM98978

SEQ ID NO: 55701 - RNA, 1410 nt, Artificial Sequence; identical to SEQ ID NO: 54350
  neuraminidase__InfluenzaA__AHM98990

SEQ ID NO: 55702 - RNA, 1410 nt, Artificial Sequence; identical to SEQ ID NO: 54350
  neuraminidase__InfluenzaA__AHM99000

SEQ ID NO: 55703 - RNA, 1410 nt, Artificial Sequence; identical to SEQ ID NO: 54350
  neuraminidase__InfluenzaA__AHM99011

SEQ ID NO: 55704 - RNA, 1410 nt, Artificial Sequence; identical to SEQ ID NO: 54326
  neuraminidase__InfluenzaA__AHM99022

SEQ ID NO: 55705 - RNA, 1410 nt, Artificial Sequence; identical to SEQ ID NO: 54326
  neuraminidase__InfluenzaA__AHM99034

SEQ ID NO: 55706 - RNA, 1410 nt, Artificial Sequence; identical to SEQ ID NO: 54326
  neuraminidase__InfluenzaA__AHM99046

SEQ ID NO: 55707 - RNA, 1410 nt, Artificial Sequence; identical to SEQ ID NO: 54326
  neuraminidase__InfluenzaA__AHM99057

SEQ ID NO: 55708 - RNA, 1410 nt, Artificial Sequence; identical to SEQ ID NO: 54326
  neuraminidase__InfluenzaA__AHM99068

SEQ ID NO: 55709 - RNA, 1410 nt, Artificial Sequence; identical to SEQ ID NO: 54350
  neuraminidase__InfluenzaA__AHM99078

SEQ ID NO: 55710 - RNA, 1410 nt, Artificial Sequence
  neuraminidase__InfluenzaA__AHN00720
augaauacaaaucaaagaauaauaaccauugggacaaucugucuaauaguuggaauaauuagucuauuauugcagauaggaaauauagucucguuauggauaagccauucaauucagacugaagaaaaaagccacccugagguaugcaaccaaagugucauuacauaugaaaacaacacaugggugaaccaaacuuauauaaacauuagcaauaccaauauugcugcuggacagggugugacuccaauaauacuagccggcaauuccucucuuugcccaaucagugggugggcuauauacagcaaagacaauagcauaaggauugguuccaaaggagacauuuuugucaugagagagccauucauuucaugcucucacuuggagugcagaaccuuuuuucugacccaaggcgcuuugcugaaugacaggcauucuaauggaaccgucaaggacaggaguccuuauagaaccuuaaugagcugcccgaucggugaagcuccaucuccguacaauucaagguucgaaucaguugcuuggucagcaagugcaugccaugauggaaugggauggcuaacaaucgggauuuccgguccagauaauggagcaguggcuguuuuaaaauacaaugguauaauaacagauacaaugaaaaguuggagaaacaaaauauuaagaacacaagagucugaauguguuuguauaaacgguucguguuuuacuauaaugacugacggcccaagcaaugggcaagccucguacaaaauauucaaaauggagaaagggaagauuauuaagucaauugagcuggaugcaccuaauuaccacuaugaggaaugcuccuguuacccugauacaggcaaaguggugugugugugcagagauaauuggcaugcuucgaaucgaccaugggucucuuucgaucagaaucuugauuaucaaauaggguacauaugcagugggguuuucggugauaacccgcguucuaaugaugggaaaggcaauuguggcccaguacuuucuaauggagcaaauggagugaagggguuuucauuuagauauggcaaugguguuuggauaggaagaacuaaaaguaucagcucuagaaguggauuugagaugauuugggauccuaauggauggacagaaacugauaguaguuucucuaugaagcaagauauuauagcauuaacugauuggucgggauacaguggaaguuuuguccaacauccugaauuaacaggaaugaacugcauaaggccuuguuucuggguagaguuaaucagagggcaacccaaggagagcacaaucuggacuaguggaagcagcauuucuuucuguggcgugaacagugaaacugcaagcuggucauggccagacggagcugaucugccauucaccauugacaaguag

SEQ ID NO: 55711 - RNA, 1410 nt, Artificial Sequence
  neuraminidase__InfluenzaA__AHN00767
augaauacaaaucaaagaauaauaaccauugggacaaucugucuaauaguuggaauaauuagucuauuauugcagauaggaaauauagucucauuauggauaagccauucaauucagacuggagaaaaaagccacccugagguaugcaaccaaagugucauuacauaugaaaacaacacaugggugaaccaaacuuauguaaacauuagcaauaccaauauugcugcuggacagggugugacuccaauaauacuagccggcaauuccucucuuugcccaaucagugggugggcuauauacagcaaagacaauagcauaaggauugguuccaaaggagacauuuuugucaugagagagccauucauuucaugcucucacuuggagugcagaaccuuuuuucugacccaaggcgcuuugcugaaugacaggcauucuaauggaaccgucaaggacaggaguccuuauagaacuuuaaugagcugcccgaucggugaagcuccaucuccguacaauucaagguucgaaucaguugcuuggucagcaagugcaugccaugauggaaugggauggcuaacaaucgggauuuccgguccagauaauggggcaguggcuguuuuaaaauacaaugguauaauaacagauacaauaaaaaguuggagaaacaaaauauuaagaacacaggagucugaauguguuuguauaaacgguucguguuuuacuauaaugacugacggcccaagcaaugggcaagccucguacaaaauauucaaaauggagaaagggaagauuauuaagucaauugagcuggaugcaccuaauuaccacuaugaggaaugcuccuguuacccugauacaggcaaaguggugugugugugcagagauaauuggcaugcuucgaaucgaccaugggucucuuucgaucagaaucuugauuaucaaauaggguacauaugcagugggguuuucggugauaacccgcguucuaaugaugggaaaggcaauuguggcccaguacuuucuaauggagcaaauggagugaagggguuuucauuuagauauggcaaugguguuuggauaggaagaacuaaaaguaucagcucuagaaguggauuugagaugauuugggauccuaauggauggacagaaacugauaguaguuucucuaugaagcaagauauuauagcauuaacugauuggucgggauacaguggaaguuuuguccaacauccugaauuaacaggaaugaacugcauaaggccuuguuucuggguagaguuaaucagagggcaacccaaggagagcacaaucuggacuaguggaagcagcauuucuuucuguggcgugaacagugaaacugcaagcuggucauggccagacggagcugaucugccauucaccauugacaaguag

SEQ ID NO: 55712 - RNA, 1398 nt, Artificial Sequence
  neuraminidase__InfluenzaA__AHN96324
augaauccaaaucagaagauucuaugcacuucagccacugcuaucauaauaggcgcaauagcaguacucauuggaauagcaaaccuaggauugaacauaggacugcaucuaaaaccgagcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugguucagauagauccaguagcaaugacacacacuagucaguauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauaugagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 55713 - RNA, 1410 nt, Artificial Sequence
  neuraminidase__InfluenzaA__AHN96448
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55714 - RNA, 1410 nt, Artificial Sequence
  neuraminidase__InfluenzaA__AHN96450
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55715 - RNA, 1410 nt, Artificial Sequence
  neuraminidase__InfluenzaA__AHN96451
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaauguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaggaggaaacugaagucuuguggaccucaaacaguauuguuguguuuuguggcaccucagguacauauggaacaggcucauggccugauggggcggaccucaaucucaugccuauauaa

SEQ ID NO: 55716 - RNA, 1410 nt, Artificial Sequence
  neuraminidase__InfluenzaA__AHN96453
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuagacaacguacauucaaauaacacaguacguaauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaagaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugacgauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55717 - RNA, 1410 nt, Artificial Sequence
  neuraminidase__InfluenzaA__AHZ13526
augaauccaaaucaaaagauaauaacaauuggcucuguuucucucaccauugcaacaauaugcuuccuuaugcaaauugccauccuaguaacuacuguaacauugcauuucaagcaauaugagugcagcucccccccaaacaaccaaguaaugccgugugaaccaauaauaauagaaagaaacaugacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagauagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacggauccagcaguagcuauugccggaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaacuccaaauugcagauaaauaggcaagucauaguugacagcaauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucuaaugccuauauaa

SEQ ID NO: 55718 - RNA, 1413 nt, Artificial Sequence
  neuraminidase__InfluenzaA__AHZ13584
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguuaauggagcagacggaguaaaaggguuuucauacaaauaugguaaugguguuuggauaggaaggaccaaaaguaacagacuuaggaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 55719 - RNA, 1410 nt, Artificial Sequence
  neuraminidase__InfluenzaA__AHZ35575
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55720 - RNA, 1410 nt, Artificial Sequence; identical to SEQ ID NO: 55719
  neuraminidase__InfluenzaA__AHZ35587

SEQ ID NO: 55721 - RNA, 1410 nt, Artificial Sequence
  neuraminidase__InfluenzaA__AHZ35611
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcagaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55722 - RNA, 1410 nt, Artificial Sequence
  neuraminidase__InfluenzaA__AHZ35623
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55723 - RNA, 1410 nt, Artificial Sequence
  neuraminidase__InfluenzaA__AHZ35635
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaacucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55724 - RNA, 1410 nt, Artificial Sequence
  neuraminidase__InfluenzaA__AHZ35647
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccugaugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55725 - RNA, 1410 nt, Artificial Sequence; identical to SEQ ID NO: 55722
  neuraminidase__InfluenzaA__AHZ35659

SEQ ID NO: 55726 - RNA, 1410 nt, Artificial Sequence; identical to SEQ ID NO: 55719
  neuraminidase__InfluenzaA__AHZ35671

SEQ ID NO: 55727 - RNA, 1410 nt, Artificial Sequence; identical to SEQ ID NO: 55722
  neuraminidase__InfluenzaA__AHZ35683

SEQ ID NO: 55728 - RNA, 1410 nt, Artificial Sequence
  neuraminidase__InfluenzaA__AHZ35695
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugagaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaacagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55729 - RNA, 1410 nt, Artificial Sequence
  neuraminidase__InfluenzaA__AHZ35719
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucacgccuauauaa

SEQ ID NO: 55730 - RNA, 1410 nt, Artificial Sequence; identical to SEQ ID NO: 55722
  neuraminidase__InfluenzaA__AHZ35731

SEQ ID NO: 55731 - RNA, 1410 nt, Artificial Sequence; identical to SEQ ID NO: 55719
  neuraminidase__InfluenzaA__AHZ35743

SEQ ID NO: 55732 - RNA, 1410 nt, Artificial Sequence; identical to SEQ ID NO: 55722
  neuraminidase__InfluenzaA__AHZ35755

SEQ ID NO: 55733 - RNA, 1410 nt, Artificial Sequence; identical to SEQ ID NO: 55719
  neuraminidase__InfluenzaA__AHZ35767

SEQ ID NO: 55734 - RNA, 1410 nt, Artificial Sequence
  neuraminidase__InfluenzaA__AHZ35779
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucaggugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55735 - RNA, 1410 nt, Artificial Sequence
  neuraminidase__InfluenzaA__AHZ35803
augaauccaaaccaaaagauaauaaccauugguucggucuguaugacaauuggaauggcuaacuuaauguuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacgguauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaaugaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55736 - RNA, 1410 nt, Artificial Sequence
  neuraminidase__InfluenzaA__AHZ35814
augaauccaaaucaaaagauaauaacgauuggcucuguuucucucaccauuuccacaauaugcuucuucaugcaaauugccauauugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggaccucugggugacaagagaaccuuaugugucaugcgauccugacaaauguuaucaauuugcccuuggacagggaacaacacuaaacaacgugcauucaaauaacacaguacgugauaggaccccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguugaguugauuaggggaagaaaagaggaaacugaaguccuguggaccucaaacaguauuguuguguuuuguggcaccucagguacauauggaacaggcucauggccugauggggcggaccucaaucucaugccuauauaa

SEQ ID NO: 55737 - RNA, 1410 nt, Artificial Sequence
  neuraminidase__InfluenzaA__AHZ35837
augaauccaaaccaaaagauaauaaccauugguucggucuguaugacaauuggaauggcuaacuuaauguuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55738 - RNA, 1410 nt, Artificial Sequence; identical to SEQ ID NO: 55737
  neuraminidase__InfluenzaA__AHZ35848

SEQ ID NO: 55739 - RNA, 1410 nt, Artificial Sequence; identical to SEQ ID NO: 55737
  neuraminidase__InfluenzaA__AHZ35859

SEQ ID NO: 55740 - RNA, 1410 nt, Artificial Sequence; identical to SEQ ID NO: 55736
  neuraminidase__InfluenzaA__AHZ35870

SEQ ID NO: 55741 - RNA, 1410 nt, Artificial Sequence
  neuraminidase__InfluenzaA__AHZ35882
augaauccaaaucaaaagauaauaacgauuggcucuguuucucucaccauuuccacaauaugcuucuucaugcaaauugccauauugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggaccucugggugacaagagaaccuuaugugucaugcgauccugacaaauguuaucaauuugcccuuggacagggaacaacacuaaacaacgugcauucaaauaacacaguacgugauaggaccccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguugaguugauuaggggaagaaaagaagaaacugaaguccuguggaccucaaacaguauuguuguguuuuguggcaccucagguacauauggaacaggcucauggccugauggggcggaccucaaucucaugccuauauaa

SEQ ID NO: 55742 - RNA, 1410 nt, Artificial Sequence
  neuraminidase__InfluenzaA__AHZ35894
augaauccaaaccaaaagauaauaaccauugguucggucuguaugacaauuggaauggcuaacuuaauguuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcagugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55743 - RNA, 1410 nt, Artificial Sequence; identical to SEQ ID NO: 55737
  neuraminidase__InfluenzaA__AHZ35905

SEQ ID NO: 55744 - RNA, 1410 nt, Artificial Sequence; identical to SEQ ID NO: 55737
  neuraminidase__InfluenzaA__AHZ35916

SEQ ID NO: 55745 - RNA, 1410 nt, Artificial Sequence
  neuraminidase__InfluenzaA__AHZ35927
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguugaaguacaacggcauaauaacagacaccaucaagaguuggagaaacaauauauugagaacacaagaguccgaaugugcauguguaaauggcuccugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55746 - RNA, 1410 nt, Artificial Sequence
  neuraminidase__InfluenzaA__AHZ35938
augaauccaaaccaaaagauaauaaccauugguucggucuguaugauaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaauacaacggcauaauaacagacacuaucaagaguuggagaaacaauauauugagaacacaagagucugaaugugcauguguaaaugguucuuguuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55747 - RNA, 1410 nt, Artificial Sequence; identical to SEQ ID NO: 55741
  neuraminidase__InfluenzaA__AHZ35949

SEQ ID NO: 55748 - RNA, 1410 nt, Artificial Sequence
  neuraminidase__InfluenzaA__AHZ35961
augaauccaaaccaaaagauaauaaccauugguucggucuguaugacaauuggaauggcuaacuuaauguuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagagcacaaucuggacuagcgggagcagcauauccuuuugugguguaaacagugacacuguggguuggucuuggccagacggugcugaguugccauuuaccauugacaaguaa

SEQ ID NO: 55749 - RNA, 1410 nt, Artificial Sequence
  neuraminidase__InfluenzaA__AHZ35972
augaauccaaaccaaaagauaauaaccauugguucggucuguaugacaauuggaauggcuaacuuaauguuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55750 - RNA, 1410 nt, Artificial Sequence
  neuraminidase__InfluenzaA__AHZ35983
augaauccaaaccaaaagauaacaaccauugguucggucuguaugacaauuggaauggcuaacuuaauguuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55751 - RNA, 1410 nt, Artificial Sequence
  neuraminidase__InfluenzaA__AHZ35994
augaauccaaaccaaaagauaauaaccauugguucggucuguaugacaauuggaauggcuaacuuaauguuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugacaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55752 - RNA, 1410 nt, Artificial Sequence; identical to SEQ ID NO: 55737
  neuraminidase__InfluenzaA__AHZ36005

SEQ ID NO: 55753 - RNA, 1410 nt, Artificial Sequence; identical to SEQ ID NO: 55749
  neuraminidase__InfluenzaA__AHZ36016

SEQ ID NO: 55754 - RNA, 1410 nt, Artificial Sequence
  neuraminidase__InfluenzaA__AHZ36027
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuauuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugaaucagucgcuuggucagcaagugcuugucaugauggcuucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcaucaguucaagaaaagguuuugagaugauuugggauccaaacggauggacugggacagacaauaacuucucaauaaagcaagauaucauaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55755 - RNA, 1410 nt, Artificial Sequence
  neuraminidase__InfluenzaA__AHZ36050
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugcacaguaguaaugacugaugggagugcuucaggaaaagcugauaccaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaagaaacgacagcuccagcaguagccauuguuuggauccuaacaaugaagaagguggucauggaguaaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55756 - RNA, 1410 nt, Artificial Sequence
  neuraminidase__InfluenzaA__AHZ36062
augaauccaaaccaaaagauaauaaccauugguucggucuguaugacaauuggaauggcuaacuuaauguuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuugggaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55757 - RNA, 1410 nt, Artificial Sequence; identical to SEQ ID NO: 55749
  neuraminidase__InfluenzaA__AHZ36084

SEQ ID NO: 55758 - RNA, 1410 nt, Artificial Sequence
  neuraminidase__InfluenzaA__AHZ36095
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuauuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugaaucagucgcuuggucagcaagugcuugucaugauggcuucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcgguugugguccaguaucgucuaauggagcaaauggaguaaaaggauuuucauucaaauacggcaaugguguuuggauagggagaacuaaaagcaucaguucaagaaaagguuuugagaugauuugggauccaaacggauggacugggacagacaauaacuucucaauaaagcaagauaucauaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55759 - RNA, 1410 nt, Artificial Sequence; identical to SEQ ID NO: 55737
  neuraminidase__InfluenzaA__AHZ36106

SEQ ID NO: 55760 - RNA, 1410 nt, Artificial Sequence
  neuraminidase__InfluenzaA__AHZ36117
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuauuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguuccauuggugaaguucccucuccauacaacucaagauuugaaucagucgcuuggucagcaagugcuugucaugauggcuucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcaucaguucaagaaaagguuuugagaugauuugggauccaaacggauggacugggacagacaauaacuucucaauaaagcaagauaucauaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55761 - RNA, 1410 nt, Artificial Sequence
  neuraminidase__InfluenzaA__AHZ36128
augaauccaaaccaaaagauaauaaccauugguucggucuguaugacaauuggaauggcuaacuuaauguuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacgggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55762 - RNA, 1410 nt, Artificial Sequence
  neuraminidase__InfluenzaA__AHZ36139
augaauccaaaccaaaagauaauaaccauugguucggucuguaugacaauuggaauggcuaacuuaauguuacaaauuggaaacauaaucucaauauggauuagccacucaauucaacuuggaaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55763 - RNA, 1410 nt, Artificial Sequence; identical to SEQ ID NO: 55755
  neuraminidase__InfluenzaA__AHZ36150

SEQ ID NO: 55764 - RNA, 1410 nt, Artificial Sequence; identical to SEQ ID NO: 55737
  neuraminidase__InfluenzaA__AHZ36161

SEQ ID NO: 55765 - RNA, 1410 nt, Artificial Sequence; identical to SEQ ID NO: 55761
  neuraminidase__InfluenzaA__AHZ36172

SEQ ID NO: 55766 - RNA, 1410 nt, Artificial Sequence
  neuraminidase__InfluenzaA__AHZ36183
augaauccaaaccaaaagauaauaaccauugguucggucuguaugacaauuggaauggcuaacuuaauguuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuuaggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55767 - RNA, 1410 nt, Artificial Sequence; identical to SEQ ID NO: 55736
  neuraminidase__InfluenzaA__AHZ36194

SEQ ID NO: 55768 - RNA, 1410 nt, Artificial Sequence; identical to SEQ ID NO: 55755
  neuraminidase__InfluenzaA__AHZ36206

SEQ ID NO: 55769 - RNA, 1410 nt, Artificial Sequence; identical to SEQ ID NO: 55737
  neuraminidase__InfluenzaA__AHZ36218

SEQ ID NO: 55770 - RNA, 1410 nt, Artificial Sequence
  neuraminidase__InfluenzaA__AHZ36229
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugcacaguaguaaugacugaugggagugcuucaggaaaagcugauaccaaaauacuauucauugaggaagggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaagaaacgacagcuccagcaguagccauuguuuggauccuaacaaugaagaagguggucauggaguaaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55771 - RNA, 1410 nt, Artificial Sequence; identical to SEQ ID NO: 55737
  neuraminidase__InfluenzaA__AHZ36241

SEQ ID NO: 55772 - RNA, 1410 nt, Artificial Sequence; identical to SEQ ID NO: 55737
  neuraminidase__InfluenzaA__AHZ36252

SEQ ID NO: 55773 - RNA, 1410 nt, Artificial Sequence; identical to SEQ ID NO: 55737
  neuraminidase__InfluenzaA__AHZ36263

SEQ ID NO: 55774 - RNA, 1410 nt, Artificial Sequence; identical to SEQ ID NO: 55722
  neuraminidase__InfluenzaA__AHZ36274

SEQ ID NO: 55775 - RNA, 1410 nt, Artificial Sequence; identical to SEQ ID NO: 55737
  neuraminidase__InfluenzaA__AHZ36286

SEQ ID NO: 55776 - RNA, 1410 nt, Artificial Sequence
  neuraminidase__InfluenzaA__AHZ36297
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccagaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaggugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55777 - RNA, 1410 nt, Artificial Sequence
  neuraminidase__InfluenzaA__AHZ36309
augaauccaaaccaaaagauaauaaccauugguucggucuguaugacaauuggaauggcuaacuuaauguuacaaauuggaaacauaaucucaauauggauuagccacucaauucaacuuggggauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55778 - RNA, 1410 nt, Artificial Sequence; identical to SEQ ID NO: 55737
  neuraminidase__InfluenzaA__AHZ36320

SEQ ID NO: 55779 - RNA, 1410 nt, Artificial Sequence; identical to SEQ ID NO: 55737
  neuraminidase__InfluenzaA__AHZ36331

SEQ ID NO: 55780 - RNA, 1410 nt, Artificial Sequence
  neuraminidase__InfluenzaA__AHZ36353
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggauaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 55781 - RNA, 1410 nt, Artificial Sequence
  neuraminidase__InfluenzaA__AHZ36365
augaauccaaaccaaaagauaauaaccauugguucggucuguaugacaauuggaauggcuaacuuaauguuacaaauuggaaacauaaucucaauauggauuagccacccaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55782 - RNA, 1410 nt, Artificial Sequence; identical to SEQ ID NO: 55780
  neuraminidase__InfluenzaA__AHZ36376

SEQ ID NO: 55783 - RNA, 1410 nt, Artificial Sequence; identical to SEQ ID NO: 55780
  neuraminidase__InfluenzaA__AHZ36388

SEQ ID NO: 55784 - RNA, 1410 nt, Artificial Sequence
  neuraminidase__InfluenzaA__AHZ36400
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacaucacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggauaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 55785 - RNA, 1410 nt, Artificial Sequence; identical to SEQ ID NO: 55722
  neuraminidase__InfluenzaA__AHZ36412

SEQ ID NO: 55786 - RNA, 1410 nt, Artificial Sequence
  neuraminidase__InfluenzaA__AHZ36424
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagacauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55787 - RNA, 1410 nt, Artificial Sequence; identical to SEQ ID NO: 55722
  neuraminidase__InfluenzaA__AHZ36436

SEQ ID NO: 55788 - RNA, 1410 nt, Artificial Sequence
  neuraminidase__InfluenzaA__AHZ36448
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaaaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55789 - RNA, 1410 nt, Artificial Sequence; identical to SEQ ID NO: 55719
  neuraminidase__InfluenzaA__AHZ36460

SEQ ID NO: 55790 - RNA, 1410 nt, Artificial Sequence; identical to SEQ ID NO: 55722
  neuraminidase__InfluenzaA__AHZ36472

SEQ ID NO: 55791 - RNA, 1410 nt, Artificial Sequence
  neuraminidase__InfluenzaA__AHZ36484
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55792 - RNA, 1410 nt, Artificial Sequence; identical to SEQ ID NO: 55722
  neuraminidase__InfluenzaA__AHZ36496

SEQ ID NO: 55793 - RNA, 1410 nt, Artificial Sequence; identical to SEQ ID NO: 55722
  neuraminidase__InfluenzaA__AHZ36508

SEQ ID NO: 55794 - RNA, 1410 nt, Artificial Sequence; identical to SEQ ID NO: 55722
  neuraminidase__InfluenzaA__AHZ36520

SEQ ID NO: 55795 - RNA, 1410 nt, Artificial Sequence
  neuraminidase__InfluenzaA__AHZ36532
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaacuuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55796 - RNA, 1410 nt, Artificial Sequence
  neuraminidase__InfluenzaA__AHZ36544
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55797 - RNA, 1410 nt, Artificial Sequence; identical to SEQ ID NO: 55786
  neuraminidase__InfluenzaA__AHZ36556

SEQ ID NO: 55798 - RNA, 1410 nt, Artificial Sequence
  neuraminidase__InfluenzaA__AHZ36568
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaacucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55799 - RNA, 1410 nt, Artificial Sequence
  neuraminidase__InfluenzaA__AHZ36580
augaauccaaaucaaaagauaauaacgauuggcucuguuucucucacuauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55800 - RNA, 1410 nt, Artificial Sequence; identical to SEQ ID NO: 55734
  neuraminidase__InfluenzaA__AHZ36592

SEQ ID NO: 55801 - RNA, 1410 nt, Artificial Sequence; identical to SEQ ID NO: 55722
  neuraminidase__InfluenzaA__AHZ36604

SEQ ID NO: 55802 - RNA, 1410 nt, Artificial Sequence; identical to SEQ ID NO: 55722
  neuraminidase__InfluenzaA__AHZ36616

SEQ ID NO: 55803 - RNA, 1410 nt, Artificial Sequence
  neuraminidase__InfluenzaA__AHZ36628
augaauccaaaucaaaagauaauaacgauuggcucuguuucucucaccauuuccacaauaugcuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuuuaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55804 - RNA, 1410 nt, Artificial Sequence
  neuraminidase__InfluenzaA__AHZ36640
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacaugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuuuucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55805 - RNA, 1410 nt, Artificial Sequence; identical to SEQ ID NO: 55722
  neuraminidase__InfluenzaA__AHZ36652

SEQ ID NO: 55806 - RNA, 1410 nt, Artificial Sequence
  neuraminidase__InfluenzaA__AHZ36664
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguuuguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55807 - RNA, 1410 nt, Artificial Sequence; identical to SEQ ID NO: 55806
  neuraminidase__InfluenzaA__AHZ36676

SEQ ID NO: 55808 - RNA, 1410 nt, Artificial Sequence; identical to SEQ ID NO: 55806
  neuraminidase__InfluenzaA__AHZ36688

SEQ ID NO: 55809 - RNA, 1398 nt, Artificial Sequence
  neuraminidase__InfluenzaA__AHZ39689
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaagauaaagugugguggaccagcaauaguauaguaucgauguguuccaguacagaauuccugggacaauggaacuggccugauggggcuaaaauagaguacuuccucuaa

SEQ ID NO: 55810 - RNA, 1398 nt, Artificial Sequence; identical to SEQ ID NO: 55809
  neuraminidase__InfluenzaA__AHZ39713

SEQ ID NO: 55811 - RNA, 1398 nt, Artificial Sequence; identical to SEQ ID NO: 55809
  neuraminidase__InfluenzaA__AHZ39725

SEQ ID NO: 55812 - RNA, 1398 nt, Artificial Sequence; identical to SEQ ID NO: 55809
  neuraminidase__InfluenzaA__AHZ39737

SEQ ID NO: 55813 - RNA, 1398 nt, Artificial Sequence
  neuraminidase__InfluenzaA__AHZ39749
augaauccaaaucagaagauucuaugcauuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaagauaaagugugguggaccagcaauaguauaguaucgauguguuccaguacagaauuccugggacaauggaacuggccugauggggcuaaaauagaguacuuccucuaa

SEQ ID NO: 55814 - RNA, 1398 nt, Artificial Sequence; identical to SEQ ID NO: 55813
  neuraminidase__InfluenzaA__AHZ39761

SEQ ID NO: 55815 - RNA, 1398 nt, Artificial Sequence; identical to SEQ ID NO: 55809
  neuraminidase__InfluenzaA__AHZ39773

SEQ ID NO: 55816 - RNA, 1398 nt, Artificial Sequence; identical to SEQ ID NO: 55809
  neuraminidase__InfluenzaA__AHZ39785

SEQ ID NO: 55817 - RNA, 1410 nt, Artificial Sequence
  neuraminidase__InfluenzaA__AHZ39797
augaauccaaaucaaaagauaauaacaauuggcucuguuucucucaccauuuccacaguaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaaucugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55818 - RNA, 1410 nt, Artificial Sequence
  neuraminidase__InfluenzaA__AHZ39821
augaauccaaaucaaaagauaauaacgauuggcucuguuucucucaccauuuccacaauaugcuucuucaugcaaacugccaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaccggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugcacaguaguaaugacugaugggagugcuucaggaaaagcugauaccaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaagaaacgacagcuccagcaguagccauuguuuggauccuaacaaugaagaagguggucauggaguaaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuacauaa

SEQ ID NO: 55819 - RNA, 1410 nt, Artificial Sequence
  neuraminidase__InfluenzaA__AHZ39833
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucaguaacaccaacuuugcugcuggacagucagugguuuccgugaaauuagcgggcaauuccucucucugcccuguuaguggaugggcuauauacaguaaagacaacaguguaagaaucgguuccaagggagauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55820 - RNA, 1410 nt, Artificial Sequence; identical to SEQ ID NO: 53829
  neuraminidase__InfluenzaA__AHZ39844

SEQ ID NO: 55821 - RNA, 1410 nt, Artificial Sequence
  neuraminidase__InfluenzaA__AHZ39856
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugccgauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55822 - RNA, 1410 nt, Artificial Sequence
  neuraminidase__InfluenzaA__AHZ39868
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucgaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55823 - RNA, 1410 nt, Artificial Sequence
  neuraminidase__InfluenzaA__AHZ39892
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaguggugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55824 - RNA, 1410 nt, Artificial Sequence; identical to SEQ ID NO: 53860
  neuraminidase__InfluenzaA__AHZ39904

SEQ ID NO: 55825 - RNA, 1410 nt, Artificial Sequence; identical to SEQ ID NO: 53860
  neuraminidase__InfluenzaA__AHZ39916

SEQ ID NO: 55826 - RNA, 1410 nt, Artificial Sequence; identical to SEQ ID NO: 53878
  neuraminidase__InfluenzaA__AHZ39928

SEQ ID NO: 55827 - RNA, 1410 nt, Artificial Sequence
  neuraminidase__InfluenzaA__AHZ39940
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacaugacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaccgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55828 - RNA, 1410 nt, Artificial Sequence; identical to SEQ ID NO: 53856
  neuraminidase__InfluenzaA__AHZ39952

SEQ ID NO: 55829 - RNA, 1410 nt, Artificial Sequence; identical to SEQ ID NO: 53829
  neuraminidase__InfluenzaA__AHZ39976

SEQ ID NO: 55830 - RNA, 1410 nt, Artificial Sequence
  neuraminidase__InfluenzaA__AHZ39988
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacaggaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacaugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaaguacucagcaugucgaagagugcucuugcuauccucgauauccuggugucagaugugucugcagagacaacuggaaaggcuccaaucggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguugaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55831 - RNA, 1410 nt, Artificial Sequence; identical to SEQ ID NO: 53878
  neuraminidase__InfluenzaA__AHZ40000

SEQ ID NO: 55832 - RNA, 1410 nt, Artificial Sequence; identical to SEQ ID NO: 55415
  neuraminidase__InfluenzaA__AHZ40012

SEQ ID NO: 55833 - RNA, 1410 nt, Artificial Sequence
  neuraminidase__InfluenzaA__AHZ40024
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguuugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcagaccucaaucucaugccuauauaa

SEQ ID NO: 55834 - RNA, 1410 nt, Artificial Sequence; identical to SEQ ID NO: 54449
  neuraminidase__InfluenzaA__AHZ40036

SEQ ID NO: 55835 - RNA, 1410 nt, Artificial Sequence; identical to SEQ ID NO: 53871
  neuraminidase__InfluenzaA__AHZ40048

SEQ ID NO: 55836 - RNA, 1410 nt, Artificial Sequence; identical to SEQ ID NO: 53856
  neuraminidase__InfluenzaA__AHZ40063

SEQ ID NO: 55837 - RNA, 1410 nt, Artificial Sequence
  neuraminidase__InfluenzaA__AHZ40075
augaauccaaaucaaaagauaauaacgauuggcucuguuucucucaccauuuccacaguaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauucuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55838 - RNA, 1410 nt, Artificial Sequence; identical to SEQ ID NO: 53829
  neuraminidase__InfluenzaA__AHZ40087

SEQ ID NO: 55839 - RNA, 1410 nt, Artificial Sequence; identical to SEQ ID NO: 53896
  neuraminidase__InfluenzaA__AHZ40099

SEQ ID NO: 55840 - RNA, 1410 nt, Artificial Sequence
  neuraminidase__InfluenzaA__AHZ40111
augaacccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucuaaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacuccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuugugcgguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccgaaguccaaauugcagauaaauaggcaagucauaguugacagagguaauagguccgguuauucugguauuuucucuguugaaggcaaaaacugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 55841 - RNA, 1410 nt, Artificial Sequence
  neuraminidase__InfluenzaA__AHZ40123
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaacagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauucucaggacccaggagucagaaugcguuuguaucaauggaacuuguacaguaguaaugacugauggaagugcuucagggaaagcugauacuaaaauacuauucauugaggaggggaaaaucguucauacuagaacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55842 - RNA, 1410 nt, Artificial Sequence; identical to SEQ ID NO: 55458
  neuraminidase__InfluenzaA__AHZ40133

SEQ ID NO: 55843 - RNA, 1410 nt, Artificial Sequence
  neuraminidase__InfluenzaA__AHZ40145
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggcuuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaggauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55844 - RNA, 1410 nt, Artificial Sequence
  neuraminidase__InfluenzaA__AHZ40157
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaacuaugccccaaacuagcagaauacagaaauuggucaaagccgcagugugacauuacaggauuugcgccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauggcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccauuguagauauaaacauaaaggaucauagcauuguuuccaguuauguguguucuggacuuguuggagacacacccagaaaaaccgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugcagucuuguggaccucaaacaguauuguuguguuuuguggcaccucagguacauauggaacaggcucauggccugauggggcggaccucaaucucaugccuauauaa

SEQ ID NO: 55845 - RNA, 1410 nt, Artificial Sequence
  neuraminidase__InfluenzaA__AHZ40169
augaauccaaaccaaaagauaauaaccauugguucggucuguaugacaauuggaauggcuaacuuaauauuacaaauuggaaacauaaucucaauauggauuagccacucaauucaacuugagaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauucaccauugacaaguaa

SEQ ID NO: 55846 - RNA, 1410 nt, Artificial Sequence
  neuraminidase__InfluenzaA__AHZ40180
augaauccaaaucaaaagauaauaacgauuggcucuguuucucucaccauuuccacaauaugcuucuucaugcaaauuaccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55847 - RNA, 1410 nt, Artificial Sequence
  neuraminidase__InfluenzaA__AHZ40192
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaccgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55848 - RNA, 1410 nt, Artificial Sequence; identical to SEQ ID NO: 53856
  neuraminidase__InfluenzaA__AHZ40204

SEQ ID NO: 55849 - RNA, 1410 nt, Artificial Sequence; identical to SEQ ID NO: 54372
  neuraminidase__InfluenzaA__AHZ40216

SEQ ID NO: 55850 - RNA, 1410 nt, Artificial Sequence
  neuraminidase__InfluenzaA__AHZ40228
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauuaucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcucaagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55851 - RNA, 1410 nt, Artificial Sequence
  neuraminidase__InfluenzaA__AHZ40240
augaauccaaaucaaaagauaauaacgauuggcucuguuucucucaccauuuccacaauaugcuuccucaugcaaauugccaucuugauaacuacugcaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucguagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaacuuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55852 - RNA, 1410 nt, Artificial Sequence
  neuraminidase__InfluenzaA__AHZ40252
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaggauaaaaaugcaacugcuagcuucauuuacaaugggaggcuuguagauaguauuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55853 - RNA, 1410 nt, Artificial Sequence
  neuraminidase__InfluenzaA__AHZ40264
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagggaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuaguacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaagaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55854 - RNA, 1410 nt, Artificial Sequence
  neuraminidase__InfluenzaA__AHZ40276
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauucucagaacccaggagucagaauguguuuguaucaauggaacuuguacaguaguaaugacugauggaagugcuucagggaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55855 - RNA, 1410 nt, Artificial Sequence
  neuraminidase__InfluenzaA__AHZ40288
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacuccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuauuucaugguccaaagacauccucaggacccaggagucagaaugcguuuguaucaauggaacuugugcgguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccgaaguccaaauugcagauaaauaggcaagucauaguugacagagguaauagguccgguuauucugguauuuucucuguugaaggcaaaaacugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 55856 - RNA, 1410 nt, Artificial Sequence
  neuraminidase__InfluenzaA__AHZ40312
augaauccaaaucaaaagauaauaacgauuggcucuguuucucucaccauuuccacaauaugcuucuucaugcaaauugccaucuugauaacuacuguaacauugcauuucaagcaauaugaauucaacuacccuccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacccuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauaccaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcguuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55857 - RNA, 1410 nt, Artificial Sequence
  neuraminidase__InfluenzaA__AHZ40324
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaauccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55858 - RNA, 1410 nt, Artificial Sequence
  neuraminidase__InfluenzaA__AHZ40336
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcauggucuagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55859 - RNA, 1410 nt, Artificial Sequence
  neuraminidase__InfluenzaA__AHZ40348
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguuugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55860 - RNA, 1410 nt, Artificial Sequence; identical to SEQ ID NO: 53860
  neuraminidase__InfluenzaA__AHZ40360

SEQ ID NO: 55861 - RNA, 1410 nt, Artificial Sequence
  neuraminidase__InfluenzaA__AHZ40372
augaauccaaaucaaaagauaauaacgauuggcucuguuucucucaccauuuccacaauaugcuucuuuaugcaaauugccaucuugauaacuacuguaacauugcauuucaagcaauaugaauucaacucucccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaacgaagaaggugaucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccuccgguacauauggaacaggcucauggccugauggggcggaccucaaucucaugccuauauaa

SEQ ID NO: 55862 - RNA, 1410 nt, Artificial Sequence
  neuraminidase__InfluenzaA__AHZ40384
augaauccaaaucaaaagauaauaacgauuggcucuguuucucucaccauuuccacaauaugcuucuucaugcaaauugccaucuugauaacuacuguaacauugcauuucaaacaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgcgauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaccgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55863 - RNA, 1410 nt, Artificial Sequence
  neuraminidase__InfluenzaA__AHZ40396
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuguugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55864 - RNA, 1410 nt, Artificial Sequence; identical to SEQ ID NO: 53856
  neuraminidase__InfluenzaA__AHZ40408

SEQ ID NO: 55865 - RNA, 1410 nt, Artificial Sequence; identical to SEQ ID NO: 53878
  neuraminidase__InfluenzaA__AHZ40420

SEQ ID NO: 55866 - RNA, 1410 nt, Artificial Sequence
  neuraminidase__InfluenzaA__AHZ40432
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuaguuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucauagauauaaacauaaaggaucauagcauuguuuccagguauguguguucaggacuuguuggagacacacccagaaaaaacgacagcuccagcaguagccauuguuuggauccuaacaaugaagaagguggucauggggugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55867 - RNA, 1410 nt, Artificial Sequence; identical to SEQ ID NO: 53856
  neuraminidase__InfluenzaA__AHZ40444

SEQ ID NO: 55868 - RNA, 1410 nt, Artificial Sequence
  neuraminidase__InfluenzaA__AHZ40456
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacaugcauucaaauaacacaguacgugauaggaccccuuaucggacccuauugaugaaugaguuggguguuccuuuucaucuggggaccaagcaagugugcauagcaugguccagcucaagcugucacgauggaaaagcauggcugcauguuuguauaacgggggaugauaaaaaugcaacugcuagcuucauuuacaauggaaggcuuguagauaguguuguuucaugguccaaagaaauccucaggacccaggagucagaaugcguuugcaucaauggaacuuguacaguaguaaugacugaugggagugcuucgggaaaagcugauacuaaaauacuauucauugaggaggggaaaaucguccauacuagcacauugucaggaagugcucagcaugucgaggagugcucuugcuauccucgauacccuggugucagaugugucugcagagacaacuggaaaggcuccaauaggcccaucguagauauaaacauaaaggaucauagcauuguuuccaguuauguguguucagggcuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggaugguccaacccuaaguccaaauugcagauaaauaggcaagucauaguugacagaggcgauagguccgguuauucugguauuuucucuguugaaggcaaaagcugcaucaaucggugcuuuuauguggaguugaucaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55869 - RNA, 1410 nt, Artificial Sequence
  neuraminidase__InfluenzaA__AHZ40468
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauugaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacggggaaugauaaaaaugcaacugcuagcuucauuuacaauggaaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaggucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55870 - RNA, 1410 nt, Artificial Sequence
  neuraminidase__InfluenzaA__AHZ40480
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacauuaaacaacgugcauucaaauaacacaguacgugauaggacuccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuugugcgguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggaguaaaaggcugggccuuugaugauggaaaugacguguggaugggaagaacgaucaacgagacgucacgcuuaggguaugaaaccuucaaagucauugaaggcugguccaacccgaaguccaaauugcagauaaauaggcaagucauaguugacagagguaauagguccgguuauuccgguauuuucucuguugaaggcaaaaacugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 55871 - RNA, 1410 nt, Artificial Sequence
  neuraminidase__InfluenzaA__AHZ40492
augaauccaaaccaaaagauaauaaccauugguucggucuguaugacaauuggaauggcuaacuuaauauuacaaauuggaaacauaaucucaauauggauuagccacucaauucaaguugggaaucaaagucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 55872 - RNA, 1410 nt, Artificial Sequence
  neuraminidase__InfluenzaA__AHZ40503
augaauccaaaucaaaagauaauaacaauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55873 - RNA, 1410 nt, Artificial Sequence; identical to SEQ ID NO: 53856
  neuraminidase__InfluenzaA__AHZ40515

SEQ ID NO: 55874 - RNA, 1410 nt, Artificial Sequence
  neuraminidase__InfluenzaA__AHZ40527
augaauccaaaucaaaagauaauaacgauuggcucuguuucucucaccauuuccacaaugugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 55875 - RNA, 1410 nt, Artificial Sequence
  neuraminidase__InfluenzaA__AHZ40539
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauagaaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguuaauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55876 - RNA, 1410 nt, Artificial Sequence; identical to SEQ ID NO: 53829
  neuraminidase__InfluenzaA__AHZ40551

SEQ ID NO: 55877 - RNA, 1410 nt, Artificial Sequence
  neuraminidase__InfluenzaA__AHZ40563
augaauccaaaucaaaagauaauaacgauuggcucuguuucucucaccauuuccacaguaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauucuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55878 - RNA, 1410 nt, Artificial Sequence
  neuraminidase__InfluenzaA__AHZ40575
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuagggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaguaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaucucaaucucaugccuauauaa

SEQ ID NO: 55879 - RNA, 1410 nt, Artificial Sequence
  neuraminidase__InfluenzaA__AHZ40586
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugaugggaaugacguguggaugggaagaacaaucaacgaaacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55880 - RNA, 1410 nt, Artificial Sequence
  neuraminidase__InfluenzaA__AHZ40598
augaauccaaaccaaaagauaauaaccauugguucggucuguaugacaauuggaauggcuaacuuaauauuacaaauuggaaacauaaucucaauauggauuagccacucaauucaaguugggaaucaaagucagauugaaacaugcaaucaaagcgucauuacuuaugaaaacaacacuuggguaaaucagacauauguuaacaucagcaacaccaacuuugcugcugggcagccagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuuuuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaacggcauaauaacagacacuaucaagaguuggagaaacgauauauugagaacacaagagucugaaugugcauguguaaaugguucuugcuuuaccauaaugacugauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 55881 - RNA, 1410 nt, Artificial Sequence
  neuraminidase__InfluenzaA__AHZ40609
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacucaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55882 - RNA, 1410 nt, Artificial Sequence
  neuraminidase__InfluenzaA__AHZ40629
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacagugcgugauaggaccccuuaucggacccuauugaugaaugaguuagguguuccuuuucaucuggggaccaagcaagugugcauagcaugguccagcucaaguugucacgauggaaaagcauggcuacaugucuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55883 - RNA, 1410 nt, Artificial Sequence; identical to SEQ ID NO: 53871
  neuraminidase__InfluenzaA__AHZ40641

SEQ ID NO: 55884 - RNA, 1410 nt, Artificial Sequence
  neuraminidase__InfluenzaA__AHZ40653
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcaggauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacgaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55885 - RNA, 1410 nt, Artificial Sequence; identical to SEQ ID NO: 53879
  neuraminidase__InfluenzaA__AHZ40665

SEQ ID NO: 55886 - RNA, 1410 nt, Artificial Sequence; identical to SEQ ID NO: 53879
  neuraminidase__InfluenzaA__AHZ40677

SEQ ID NO: 55887 - RNA, 1410 nt, Artificial Sequence; identical to SEQ ID NO: 53856
  neuraminidase__InfluenzaA__AHZ40689

SEQ ID NO: 55888 - RNA, 1410 nt, Artificial Sequence
  neuraminidase__InfluenzaA__AHZ40713
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucuuaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauaaguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55889 - RNA, 1410 nt, Artificial Sequence
  neuraminidase__InfluenzaA__AHZ40725
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccgguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55890 - RNA, 1410 nt, Artificial Sequence; identical to SEQ ID NO: 53868
  neuraminidase__InfluenzaA__AHZ40737

SEQ ID NO: 55891 - RNA, 1410 nt, Artificial Sequence
  neuraminidase__InfluenzaA__AHZ40749
augaauccaaaucaaaagauaauaacgauuggcucuguuucucucaccauuuccacaauaugccucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucugggaaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcccauggccugauggggcggaccucaaucucaugccuauauaa

SEQ ID NO: 55892 - RNA, 1410 nt, Artificial Sequence
  neuraminidase__InfluenzaA__AHZ40761
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaacuaugccccaaacuagcagaauacagaaauuggucaaagccgcagugugacauuacaggauuugcgccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauggcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccauuguagauauaaacauaaaggaucauagcauuguuuccaguuauguguguucaggacuuguuggagacacacccagaaaaaccgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaaaaggaaacugcagucuuguggaccucaaacaguauuguuguguuuuguggcaccucagguacauauggaacaggcucauggccugauggggcggaccucaaucucaugccuauauaa

SEQ ID NO: 55893 - RNA, 1410 nt, Artificial Sequence; identical to SEQ ID NO: 53829
  neuraminidase__InfluenzaA__AHZ40773

SEQ ID NO: 55894 - RNA, 1410 nt, Artificial Sequence; identical to SEQ ID NO: 47232
  neuraminidase__InfluenzaA__AHZ40785

SEQ ID NO: 55895 - RNA, 1410 nt, Artificial Sequence; identical to SEQ ID NO: 47232
  neuraminidase__InfluenzaA__AHZ40796

SEQ ID NO: 55896 - RNA, 1410 nt, Artificial Sequence; identical to SEQ ID NO: 47232
  neuraminidase__InfluenzaA__AHZ40807

SEQ ID NO: 55897 - RNA, 1410 nt, Artificial Sequence; identical to SEQ ID NO: 47232
  neuraminidase__InfluenzaA__AHZ40818

SEQ ID NO: 55898 - RNA, 1410 nt, Artificial Sequence; identical to SEQ ID NO: 47232
  neuraminidase__InfluenzaA__AHZ40829

SEQ ID NO: 55899 - RNA, 1410 nt, Artificial Sequence; identical to SEQ ID NO: 47232
  neuraminidase__InfluenzaA__AHZ40840

SEQ ID NO: 55900 - RNA, 1410 nt, Artificial Sequence; identical to SEQ ID NO: 47232
  neuraminidase__InfluenzaA__AHZ40851

SEQ ID NO: 55901 - RNA, 1410 nt, Artificial Sequence; identical to SEQ ID NO: 47232
  neuraminidase__InfluenzaA__AHZ40862

SEQ ID NO: 55902 - RNA, 1410 nt, Artificial Sequence; identical to SEQ ID NO: 47232
  neuraminidase__InfluenzaA__AHZ40873

SEQ ID NO: 55903 - RNA, 1410 nt, Artificial Sequence; identical to SEQ ID NO: 47232
  neuraminidase__InfluenzaA__AHZ40884

SEQ ID NO: 55904 - RNA, 1410 nt, Artificial Sequence; identical to SEQ ID NO: 47232
  neuraminidase__InfluenzaA__AHZ40895

SEQ ID NO: 55905 - RNA, 1410 nt, Artificial Sequence; identical to SEQ ID NO: 47232
  neuraminidase__InfluenzaA__AHZ40906

SEQ ID NO: 55906 - RNA, 1410 nt, Artificial Sequence; identical to SEQ ID NO: 47232
  neuraminidase__InfluenzaA__AHZ40917

SEQ ID NO: 55907 - RNA, 1410 nt, Artificial Sequence; identical to SEQ ID NO: 47232
  neuraminidase__InfluenzaA__AHZ40928

SEQ ID NO: 55908 - RNA, 1410 nt, Artificial Sequence; identical to SEQ ID NO: 47232
  neuraminidase__InfluenzaA__AHZ40939

SEQ ID NO: 55909 - RNA, 1410 nt, Artificial Sequence; identical to SEQ ID NO: 47232
  neuraminidase__InfluenzaA__AHZ40950

SEQ ID NO: 55910 - RNA, 1410 nt, Artificial Sequence; identical to SEQ ID NO: 47232
  neuraminidase__InfluenzaA__AHZ40961

SEQ ID NO: 55911 - RNA, 1410 nt, Artificial Sequence; identical to SEQ ID NO: 47232
  neuraminidase__InfluenzaA__AHZ40972

SEQ ID NO: 55912 - RNA, 1410 nt, Artificial Sequence; identical to SEQ ID NO: 47232
  neuraminidase__InfluenzaA__AHZ40983

SEQ ID NO: 55913 - RNA, 1410 nt, Artificial Sequence
  neuraminidase__InfluenzaA__AHZ40994
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaacuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55914 - RNA, 1410 nt, Artificial Sequence; identical to SEQ ID NO: 47232
  neuraminidase__InfluenzaA__AHZ41005

SEQ ID NO: 55915 - RNA, 1410 nt, Artificial Sequence; identical to SEQ ID NO: 47232
  neuraminidase__InfluenzaA__AHZ41016

SEQ ID NO: 55916 - RNA, 1410 nt, Artificial Sequence; identical to SEQ ID NO: 47232
  neuraminidase__InfluenzaA__AHZ41027

SEQ ID NO: 55917 - RNA, 1410 nt, Artificial Sequence; identical to SEQ ID NO: 47232
  neuraminidase__InfluenzaA__AHZ41049

SEQ ID NO: 55918 - RNA, 1410 nt, Artificial Sequence; identical to SEQ ID NO: 47232
  neuraminidase__InfluenzaA__AHZ41060

SEQ ID NO: 55919 - RNA, 1410 nt, Artificial Sequence; identical to SEQ ID NO: 47232
  neuraminidase__InfluenzaA__AHZ41071

SEQ ID NO: 55920 - RNA, 1410 nt, Artificial Sequence; identical to SEQ ID NO: 47232
  neuraminidase__InfluenzaA__AHZ41082

SEQ ID NO: 55921 - RNA, 1410 nt, Artificial Sequence; identical to SEQ ID NO: 47232
  neuraminidase__InfluenzaA__AHZ41093

SEQ ID NO: 55922 - RNA, 1410 nt, Artificial Sequence; identical to SEQ ID NO: 47232
  neuraminidase__InfluenzaA__AHZ41104

SEQ ID NO: 55923 - RNA, 1410 nt, Artificial Sequence; identical to SEQ ID NO: 47232
  neuraminidase__InfluenzaA__AHZ41115

SEQ ID NO: 55924 - RNA, 1410 nt, Artificial Sequence; identical to SEQ ID NO: 47232
  neuraminidase__InfluenzaA__AHZ41126

SEQ ID NO: 55925 - RNA, 1410 nt, Artificial Sequence; identical to SEQ ID NO: 47232
  neuraminidase__InfluenzaA__AHZ41137

SEQ ID NO: 55926 - RNA, 1410 nt, Artificial Sequence; identical to SEQ ID NO: 47232
  neuraminidase__InfluenzaA__AHZ41148

SEQ ID NO: 55927 - RNA, 1410 nt, Artificial Sequence; identical to SEQ ID NO: 47232
  neuraminidase__InfluenzaA__AHZ41159

SEQ ID NO: 55928 - RNA, 1410 nt, Artificial Sequence; identical to SEQ ID NO: 47232
  neuraminidase__InfluenzaA__AHZ41170

SEQ ID NO: 55929 - RNA, 1410 nt, Artificial Sequence; identical to SEQ ID NO: 47232
  neuraminidase__InfluenzaA__AHZ41181

SEQ ID NO: 55930 - RNA, 1410 nt, Artificial Sequence; identical to SEQ ID NO: 47232
  neuraminidase__InfluenzaA__AHZ41205

SEQ ID NO: 55931 - RNA, 1410 nt, Artificial Sequence; identical to SEQ ID NO: 47232
  neuraminidase__InfluenzaA__AHZ41251

SEQ ID NO: 55932 - RNA, 1410 nt, Artificial Sequence; identical to SEQ ID NO: 47232
  neuraminidase__InfluenzaA__AHZ41266

SEQ ID NO: 55933 - RNA, 1410 nt, Artificial Sequence; identical to SEQ ID NO: 47232
  neuraminidase__InfluenzaA__AHZ41284

SEQ ID NO: 55934 - RNA, 1410 nt, Artificial Sequence; identical to SEQ ID NO: 47232
  neuraminidase__InfluenzaA__AHZ41295

SEQ ID NO: 55935 - RNA, 1410 nt, Artificial Sequence; identical to SEQ ID NO: 47232
  neuraminidase__InfluenzaA__AHZ41306

SEQ ID NO: 55936 - RNA, 1410 nt, Artificial Sequence; identical to SEQ ID NO: 47232
  neuraminidase__InfluenzaA__AHZ41317

SEQ ID NO: 55937 - RNA, 1410 nt, Artificial Sequence; identical to SEQ ID NO: 47232
  neuraminidase__InfluenzaA__AHZ41328

SEQ ID NO: 55938 - RNA, 1410 nt, Artificial Sequence; identical to SEQ ID NO: 47232
  neuraminidase__InfluenzaA__AHZ41339

SEQ ID NO: 55939 - RNA, 1410 nt, Artificial Sequence; identical to SEQ ID NO: 47232
  neuraminidase__InfluenzaA__AHZ41350

SEQ ID NO: 55940 - RNA, 1410 nt, Artificial Sequence; identical to SEQ ID NO: 47232
  neuraminidase__InfluenzaA__AHZ41369

SEQ ID NO: 55941 - RNA, 1410 nt, Artificial Sequence; identical to SEQ ID NO: 47232
  neuraminidase__InfluenzaA__AHZ41380

SEQ ID NO: 55942 - RNA, 1410 nt, Artificial Sequence; identical to SEQ ID NO: 47232
  neuraminidase__InfluenzaA__AHZ41391

SEQ ID NO: 55943 - RNA, 1410 nt, Artificial Sequence; identical to SEQ ID NO: 47232
  neuraminidase__InfluenzaA__AHZ41402

SEQ ID NO: 55944 - RNA, 1410 nt, Artificial Sequence; identical to SEQ ID NO: 47232
  neuraminidase__InfluenzaA__AHZ41413

SEQ ID NO: 55945 - RNA, 1410 nt, Artificial Sequence; identical to SEQ ID NO: 47232
  neuraminidase__InfluenzaA__AHZ41444

SEQ ID NO: 55946 - RNA, 1410 nt, Artificial Sequence; identical to SEQ ID NO: 47232
  neuraminidase__InfluenzaA__AHZ41455

SEQ ID NO: 55947 - RNA, 1410 nt, Artificial Sequence; identical to SEQ ID NO: 47232
  neuraminidase__InfluenzaA__AHZ41476

SEQ ID NO: 55948 - RNA, 1410 nt, Artificial Sequence; identical to SEQ ID NO: 47232
  neuraminidase__InfluenzaA__AHZ41487

SEQ ID NO: 55949 - RNA, 1410 nt, Artificial Sequence; identical to SEQ ID NO: 47232
  neuraminidase__InfluenzaA__AHZ41498

SEQ ID NO: 55950 - RNA, 1410 nt, Artificial Sequence; identical to SEQ ID NO: 47232
  neuraminidase__InfluenzaA__AHZ41509

SEQ ID NO: 55951 - RNA, 1410 nt, Artificial Sequence; identical to SEQ ID NO: 47232
  neuraminidase__InfluenzaA__AHZ41520

SEQ ID NO: 55952 - RNA, 1410 nt, Artificial Sequence; identical to SEQ ID NO: 47232
  neuraminidase__InfluenzaA__AHZ41531

SEQ ID NO: 55953 - RNA, 1410 nt, Artificial Sequence; identical to SEQ ID NO: 47232
  neuraminidase__InfluenzaA__AHZ41542

SEQ ID NO: 55954 - RNA, 1410 nt, Artificial Sequence; identical to SEQ ID NO: 47232
  neuraminidase__InfluenzaA__AHZ41553

SEQ ID NO: 55955 - RNA, 1410 nt, Artificial Sequence; identical to SEQ ID NO: 47232
  neuraminidase__InfluenzaA__AHZ41564

SEQ ID NO: 55956 - RNA, 1410 nt, Artificial Sequence; identical to SEQ ID NO: 47232
  neuraminidase__InfluenzaA__AHZ41586

SEQ ID NO: 55957 - RNA, 1410 nt, Artificial Sequence; identical to SEQ ID NO: 47232
  neuraminidase__InfluenzaA__AHZ41597

SEQ ID NO: 55958 - RNA, 1410 nt, Artificial Sequence; identical to SEQ ID NO: 47232
  neuraminidase__InfluenzaA__AHZ41608

SEQ ID NO: 55959 - RNA, 1410 nt, Artificial Sequence; identical to SEQ ID NO: 47232
  neuraminidase__InfluenzaA__AHZ41619

SEQ ID NO: 55960 - RNA, 1410 nt, Artificial Sequence; identical to SEQ ID NO: 47232
  neuraminidase__InfluenzaA__AHZ41630

SEQ ID NO: 55961 - RNA, 1410 nt, Artificial Sequence; identical to SEQ ID NO: 47232
  neuraminidase__InfluenzaA__AHZ41641

SEQ ID NO: 55962 - RNA, 1410 nt, Artificial Sequence; identical to SEQ ID NO: 47232
  neuraminidase__InfluenzaA__AHZ41652

SEQ ID NO: 55963 - RNA, 1410 nt, Artificial Sequence; identical to SEQ ID NO: 47232
  neuraminidase__InfluenzaA__AHZ41663

SEQ ID NO: 55964 - RNA, 1410 nt, Artificial Sequence; identical to SEQ ID NO: 47232
  neuraminidase__InfluenzaA__AHZ41674

SEQ ID NO: 55965 - RNA, 1410 nt, Artificial Sequence; identical to SEQ ID NO: 47232
  neuraminidase__InfluenzaA__AHZ41685

SEQ ID NO: 55966 - RNA, 1410 nt, Artificial Sequence; identical to SEQ ID NO: 47232
  neuraminidase__InfluenzaA__AHZ41696

SEQ ID NO: 55967 - RNA, 1410 nt, Artificial Sequence; identical to SEQ ID NO: 47232
  neuraminidase__InfluenzaA__AHZ41707

SEQ ID NO: 55968 - RNA, 1410 nt, Artificial Sequence; identical to SEQ ID NO: 47232
  neuraminidase__InfluenzaA__AHZ41718

SEQ ID NO: 55969 - RNA, 1410 nt, Artificial Sequence; identical to SEQ ID NO: 47232
  neuraminidase__InfluenzaA__AHZ41729

SEQ ID NO: 55970 - RNA, 1410 nt, Artificial Sequence; identical to SEQ ID NO: 47232
  neuraminidase__InfluenzaA__AHZ41740

SEQ ID NO: 55971 - RNA, 1410 nt, Artificial Sequence; identical to SEQ ID NO: 47232
  neuraminidase__InfluenzaA__AHZ41751

SEQ ID NO: 55972 - RNA, 1410 nt, Artificial Sequence; identical to SEQ ID NO: 47232
  neuraminidase__InfluenzaA__AHZ41762

SEQ ID NO: 55973 - RNA, 1410 nt, Artificial Sequence
  neuraminidase__InfluenzaA__AHZ42564
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggaauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacaggacuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55974 - RNA, 1410 nt, Artificial Sequence
  neuraminidase__InfluenzaA__AHZ42575
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgccuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55975 - RNA, 1410 nt, Artificial Sequence
  neuraminidase__InfluenzaA__AHZ42587
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaaugugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55976 - RNA, 1413 nt, Artificial Sequence
  neuraminidase__InfluenzaA__AHZ42599
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaaaaacaaccaagugaugcugugugaaccgacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucagaaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55977 - RNA, 1410 nt, Artificial Sequence; identical to SEQ ID NO: 55871
  neuraminidase__InfluenzaA__AHZ42611

SEQ ID NO: 55978 - RNA, 1410 nt, Artificial Sequence; identical to SEQ ID NO: 53829
  neuraminidase__InfluenzaA__AHZ42622

SEQ ID NO: 55979 - RNA, 1410 nt, Artificial Sequence
  neuraminidase__InfluenzaA__AHZ42634
augaauccaaaucaaaagauaauaacgauuggcucuguuucucucaccauuuccacaguaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcacgucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauucuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55980 - RNA, 1410 nt, Artificial Sequence
  neuraminidase__InfluenzaA__AHZ42646
augaauccaaaccaaaagauaauaaccauugguucggucuguaugacaauuggaauggcuaacuuaauauuacaaauuggaaacauaaucucaauauggauuagccacucaauucaaguugggaaucaaagucagauugaaacaugcaaucaaagcgucauuacuuaugaaaacaacacuuggguaaaucagacauauguuaacaucagcaacaccaacuuugcugcugggcagccagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaacggcauaauaacagacacuaucaagaguuggagaaacgauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 55981 - RNA, 1410 nt, Artificial Sequence
  neuraminidase__InfluenzaA__AHZ42657
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaaugagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55982 - RNA, 1410 nt, Artificial Sequence
  neuraminidase__InfluenzaA__AHZ42669
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauauuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugaugggaaugacguguggaugggaagaacaaucaacgaaacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguugaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55983 - RNA, 1410 nt, Artificial Sequence; identical to SEQ ID NO: 54414
  neuraminidase__InfluenzaA__AHZ42681

SEQ ID NO: 55984 - RNA, 1410 nt, Artificial Sequence
  neuraminidase__InfluenzaA__AHZ42693
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcaucauauccuucugugguguaaacagugacacuguggguuggucuuggccagacggugcugaguugccauuuaccauugacaaguaa

SEQ ID NO: 55985 - RNA, 1410 nt, Artificial Sequence; identical to SEQ ID NO: 53829
  neuraminidase__InfluenzaA__AHZ42704

SEQ ID NO: 55986 - RNA, 1410 nt, Artificial Sequence
  neuraminidase__InfluenzaA__AHZ42716
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauuucagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55987 - RNA, 1410 nt, Artificial Sequence; identical to SEQ ID NO: 53829
  neuraminidase__InfluenzaA__AHZ42728

SEQ ID NO: 55988 - RNA, 1410 nt, Artificial Sequence
  neuraminidase__InfluenzaA__AHZ42740
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucaguaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggguauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55989 - RNA, 1410 nt, Artificial Sequence; identical to SEQ ID NO: 53871
  neuraminidase__InfluenzaA__AHZ42751

SEQ ID NO: 55990 - RNA, 1410 nt, Artificial Sequence
  neuraminidase__InfluenzaA__AHZ42763
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguauauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcuccagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaauuacagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55991 - RNA, 1410 nt, Artificial Sequence; identical to SEQ ID NO: 53879
  neuraminidase__InfluenzaA__AHZ42775

SEQ ID NO: 55992 - RNA, 1410 nt, Artificial Sequence; identical to SEQ ID NO: 53856
  neuraminidase__InfluenzaA__AHZ42787

SEQ ID NO: 55993 - RNA, 1410 nt, Artificial Sequence
  neuraminidase__InfluenzaA__AHZ42799
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucauagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55994 - RNA, 1410 nt, Artificial Sequence
  neuraminidase__InfluenzaA__AHZ42811
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguuggcagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55995 - RNA, 1410 nt, Artificial Sequence
  neuraminidase__InfluenzaA__AHZ42823
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucaguaacaccaacuuugcugcugaacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 55996 - RNA, 1410 nt, Artificial Sequence
  neuraminidase__InfluenzaA__AHZ42834
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55997 - RNA, 1410 nt, Artificial Sequence; identical to SEQ ID NO: 54449
  neuraminidase__InfluenzaA__AHZ42846

SEQ ID NO: 55998 - RNA, 1410 nt, Artificial Sequence
  neuraminidase__InfluenzaA__AHZ42858
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacgaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 55999 - RNA, 1410 nt, Artificial Sequence; identical to SEQ ID NO: 55192
  neuraminidase__InfluenzaA__AHZ42870

SEQ ID NO: 56000 - RNA, 1410 nt, Artificial Sequence; identical to SEQ ID NO: 54449
  neuraminidase__InfluenzaA__AHZ42882

SEQ ID NO: 56001 - RNA, 1410 nt, Artificial Sequence
  neuraminidase__InfluenzaA__AHZ42894
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaggaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacaaaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56002 - RNA, 1410 nt, Artificial Sequence
  neuraminidase__InfluenzaA__AHZ42906
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacaggggacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugccagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56003 - RNA, 1410 nt, Artificial Sequence
  neuraminidase__InfluenzaA__AHZ42918
augaauccaaaucaaaagauaauaacgauuggcucuguuucucucaccauuuccacaauaugcuucuucaugcaaauugccaucuugauaacuacuguaacauugcauuucaagcaauaugaauucaauucccccccaaacaaccaagugaugcugugugaaccaacaauaauagaaagaaacauaacagagauaguguaucuaaccaacaccaccauagagaaggaaauaugccccaaaccagcagaauacagaaauuggucaaagccgcagugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaaguaugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggaaucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggccuaucguagauauaaacauaaaggaucauagcauuguuuccagguauguguguucaggacuuguuggagacacacccagaaaaaacgacagcucaagcaguagccauuguuuggauccuaacaaugaagaagguggucauggagugaaaggcugggccuucgaugauggaaaugacguguggaugggaagaacgaucaacgagacgucacguuuaggguaugaaaccuucaaagucauugaaggcugguccaacccuaaguccaaacugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56004 - RNA, 1398 nt, Artificial Sequence; identical to SEQ ID NO: 55809
  neuraminidase__InfluenzaA__AHZ59750

SEQ ID NO: 56005 - RNA, 1398 nt, Artificial Sequence; identical to SEQ ID NO: 55809
  neuraminidase__InfluenzaA__AHZ59762

SEQ ID NO: 56006 - RNA, 1398 nt, Artificial Sequence; identical to SEQ ID NO: 55809
  neuraminidase__InfluenzaA__AHZ59774

SEQ ID NO: 56007 - RNA, 1398 nt, Artificial Sequence; identical to SEQ ID NO: 55809
  neuraminidase__InfluenzaA__AHZ59786

SEQ ID NO: 56008 - RNA, 1398 nt, Artificial Sequence; identical to SEQ ID NO: 55809
  neuraminidase__InfluenzaA__AHZ59798

SEQ ID NO: 56009 - RNA, 1398 nt, Artificial Sequence; identical to SEQ ID NO: 55809
  neuraminidase__InfluenzaA__AHZ59810

SEQ ID NO: 56010 - RNA, 1398 nt, Artificial Sequence; identical to SEQ ID NO: 55809
  neuraminidase__InfluenzaA__AHZ59822

SEQ ID NO: 56011 - RNA, 1398 nt, Artificial Sequence; identical to SEQ ID NO: 55809
  neuraminidase__InfluenzaA__AHZ59834

SEQ ID NO: 56012 - RNA, 1398 nt, Artificial Sequence; identical to SEQ ID NO: 55809
  neuraminidase__InfluenzaA__AHZ59846

SEQ ID NO: 56013 - RNA, 1398 nt, Artificial Sequence; identical to SEQ ID NO: 55809
  neuraminidase__InfluenzaA__AHZ59858

SEQ ID NO: 56014 - RNA, 1398 nt, Artificial Sequence; identical to SEQ ID NO: 55809
  neuraminidase__InfluenzaA__AHZ59870

SEQ ID NO: 56015 - RNA, 1398 nt, Artificial Sequence; identical to SEQ ID NO: 55809
  neuraminidase__InfluenzaA__AHZ59882

SEQ ID NO: 56016 - RNA, 1398 nt, Artificial Sequence; identical to SEQ ID NO: 55809
  neuraminidase__InfluenzaA__AHZ59918

SEQ ID NO: 56017 - RNA, 1398 nt, Artificial Sequence; identical to SEQ ID NO: 55809
  neuraminidase__InfluenzaA__AHZ59930

SEQ ID NO: 56018 - RNA, 1398 nt, Artificial Sequence; identical to SEQ ID NO: 55809
  neuraminidase__InfluenzaA__AHZ59942

SEQ ID NO: 56019 - RNA, 1398 nt, Artificial Sequence; identical to SEQ ID NO: 55809
  neuraminidase__InfluenzaA__AHZ59954

SEQ ID NO: 56020 - RNA, 1398 nt, Artificial Sequence; identical to SEQ ID NO: 55809
  neuraminidase__InfluenzaA__AHZ59966

SEQ ID NO: 56021 - RNA, 1398 nt, Artificial Sequence; identical to SEQ ID NO: 55809
  neuraminidase__InfluenzaA__AHZ59991

SEQ ID NO: 56022 - RNA, 1398 nt, Artificial Sequence; identical to SEQ ID NO: 55809
  neuraminidase__InfluenzaA__AHZ60003

SEQ ID NO: 56023 - RNA, 1398 nt, Artificial Sequence; identical to SEQ ID NO: 55809
  neuraminidase__InfluenzaA__AHZ60015

SEQ ID NO: 56024 - RNA, 1398 nt, Artificial Sequence; identical to SEQ ID NO: 55809
  neuraminidase__InfluenzaA__AHZ60027

SEQ ID NO: 56025 - RNA, 1398 nt, Artificial Sequence; identical to SEQ ID NO: 55809
  neuraminidase__InfluenzaA__AHZ60039

SEQ ID NO: 56026 - RNA, 1398 nt, Artificial Sequence; identical to SEQ ID NO: 55809
  neuraminidase__InfluenzaA__AHZ60051

SEQ ID NO: 56027 - RNA, 1398 nt, Artificial Sequence; identical to SEQ ID NO: 55809
  neuraminidase__InfluenzaA__AHZ60063

SEQ ID NO: 56028 - RNA, 1398 nt, Artificial Sequence; identical to SEQ ID NO: 55809
  neuraminidase__InfluenzaA__AHZ60075

SEQ ID NO: 56029 - RNA, 1398 nt, Artificial Sequence; identical to SEQ ID NO: 55809
  neuraminidase__InfluenzaA__AHZ60087

SEQ ID NO: 56030 - RNA, 1398 nt, Artificial Sequence; identical to SEQ ID NO: 55809
  neuraminidase__InfluenzaA__AHZ60099

SEQ ID NO: 56031 - RNA, 1410 nt, Artificial Sequence; identical to SEQ ID NO: 53856
  neuraminidase__InfluenzaA__AHZ60111

SEQ ID NO: 56032 - RNA, 1410 nt, Artificial Sequence
  neuraminidase__InfluenzaA__AIA26299
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucgguguuuuuauguggaguugauaaggggaagaaaagaggaaacugaaguuuuguggaccucaaacaguauuguuguguuuuguggcaccuccgguacauauggaacaggcucauggccugauggggcggacaucaaucucaugccuauauaa

SEQ ID NO: 56033 - RNA, 1374 nt, Artificial Sequence
  neuraminidase__InfluenzaA__AIC64891
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56034 - RNA, 1350 nt, Artificial Sequence
  neuraminidase__InfluenzaA__AID48084
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaaucuucuuacugagaaaacuguggcuucaguaaaauuagcgggcaauucaucucuuugccccauuaauggaugggcuguauacaguaaggacaacaguauaaggaucgguuccaagggggauguguuuguuauaagagagccauucaucucaugcucccacuuggaaugcagaacuuucuuuuugacucagggagccuugcugaaugacaagcacuccaaugggacugucaaagacagaaguccucacagaacauuaaugaguuguccugugggugaggcucccuccccauacaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggaaaaaggaaaagugguuaaaucagucgaauuggaugcucccaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggagcagguaguugugguccgguguccucuaacggggcauaugggguaaaaggguuuucauuuaaauacggcaauggugucuggaucgggagaacaaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 56035 - RNA, 1410 nt, Artificial Sequence
  neuraminidase__InfluenzaA__AID70507
augaauccaaaccaaaagauaauaaccauugguucggucuguacgacaauuggaauggcuaacuuaauauuacaaauuggaaacauaaucucaauauggauuagccacucaauucaacuugggaaucaaaaucagauugaaacaugcaaucaaagcgucauuacuuaugaaaacaaaacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaccuggaauaucagauaggauacauaugcagugggauuuucggagacaauccacgcccuaaugauaagacaggcaguugugauccaguaucguuuaauggagcaaauggaguaaaaggguuuucauucaaauacggcaaugguguuuggauagggagaacuaaaagcauuaguucaagaaacgguuuugagaugauuugggauccgaacggauggaccgggacagacaauaaauucucaauaaagcaagauauuguaggaauaaaugaguggucaggauauagcgggaguuuuguucagcauccagaacuaacagggcuggauuguauaagaccuugcuucuggguugaacuaaucagagggcgacccaaagagaacacaauuuggacuagcgggagcagcauauccuuuugugguguaaacagugacacuguggguugguuuuggccagacggugcugaguugccauuuaccauugacaaguaa

SEQ ID NO: 56036 - RNA, 1410 nt, Artificial Sequence
  neuraminidase__InfluenzaA__AID70508
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccaaacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauugcauaagaccuugcuucuggguugaacuaaucagagggcgacccaaagagaacacaaucuggacuagcgggagcagcauauccuuuugugguguaaacagugacacuguggguuggucuuggccagacggugcugaauugccauuuaccauugacaaguaa

SEQ ID NO: 56037 - RNA, 1410 nt, Artificial Sequence
  neuraminidase__InfluenzaA__AID70509
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaauuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucaguugaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56038 - RNA, 1410 nt, Artificial Sequence
  neuraminidase__InfluenzaA__AID70510
augaauccaaaccaaaagauaauaaccauugguucggucuguauaacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucaguugcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaauuacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56039 - RNA, 1410 nt, Artificial Sequence
  neuraminidase__InfluenzaA__AID70511
augaauccaaaccaaaagauaauaaccauggguucggucuggaugacaauuggaauggcuaacuugauauuacaaaguggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56040 - RNA, 1410 nt, Artificial Sequence
  neuraminidase__InfluenzaA__AID70512
augaauccaaaccaaaagauaauaaccauugguucggucuggaugacaauuggaauggcuaaccuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuucugugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaggccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcaguauauccuuuugugguguaaacagugacacuguggguuggucuuggccagacggugcugaguugccauuuaccauugacaaguaa

SEQ ID NO: 56041 - RNA, 1410 nt, Artificial Sequence; identical to SEQ ID NO: 51098
  neuraminidase__InfluenzaA__AID70514

SEQ ID NO: 56042 - RNA, 1410 nt, Artificial Sequence
  neuraminidase__InfluenzaA__AID70515
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaauuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaaugggguaaaaggauuuucauucaaauacagcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56043 - RNA, 1410 nt, Artificial Sequence
  neuraminidase__InfluenzaA__AID70516
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56044 - RNA, 1410 nt, Artificial Sequence
  neuraminidase__InfluenzaA__AID70517
augaauccaaaccaaaagauaauaaccauugguucggucuguaugacaauuggaauggcuaacuuaacauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56045 - RNA, 1410 nt, Artificial Sequence
  neuraminidase__InfluenzaA__AID70518
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaauucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56046 - RNA, 1410 nt, Artificial Sequence
  neuraminidase__InfluenzaA__AID70519
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuucugugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguuccuucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaggccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56047 - RNA, 1410 nt, Artificial Sequence
  neuraminidase__InfluenzaA__AID70520
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacaguggcacuguggguuggucuuggccagacggugcugaguugccauuuaccauugacaaguaa

SEQ ID NO: 56048 - RNA, 1410 nt, Artificial Sequence
  neuraminidase__InfluenzaA__AID70521
augaauccaaaucaaaagauaauaacgauuggcucuguuucucucacuauuuccaggauaugcuucuucaugcaaauugccaucuuaauaaauacuguaacauugcauuucaagcaauaugaauucaacucccccccaaacaaccaagugaugcugugugaaccaacaauaauagaaagaaacauaacaaagauaguguaucugacaaacacuaccauagagaaggaaauaugccccaaacuagcagaauacagaaguuggucgaagccgcaaugugacauuacaggauuugcaccuuuuucuaaggacaauucgauuaggcuuuccgcugguggggacaucugggugacaagagaaccuuaugugucaugcgaucccgacaaguguuuucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgaugggaaagcauggcugcauguuuguauaacgggagaugauaaaaaugcaacugcuagcaucauuuacaaugggaggcuaguagauaguauuguuucaugguccaaaaaaauacucaggacccaggagucagaaugcguuuguaucaauggaacuuguacaguaguaaugacugaugggagugcuucagggaaagcugauacuaaaauacuauucauugaggaggggaaaaucguucauaccagcacauugucaggaagugcucagcaugucgaggagugcuccugcuauccucgauauccuggugucagaugugucuguagagacaacuggaaaggcuccaauaggcccaucguagauauaaacauaaaggauuauagcauuguuuccaguuaugugugcucgggauucguuggagacacacccagaaaacccgacagauccagcaguagccauugcuuggauccuaacaaugaagaagguggucauggagugaaaggcugggccuuugacgaugggaaugacguguggaugggaagaacaaucagcgagaagucacgauuaggauaugaaaccuucaaagucauuggaggcugguccaacccuaauuccaaaucacagauaaauagacaagucauaguugacagagguaauagguccgguuauucugguauuuucucuguugaaggcaaaagcugcaucaaucggugcuuuuauguggaguugauaaggggaagaaaagaugaaacugaagucuuguggaccucaaacaguauuguuguguuuuguggcaccucagguacauauggaacaggcucauggccugauggggcggacaucaaucucaugccuauauaa

SEQ ID NO: 56049 - RNA, 1410 nt, Artificial Sequence
  neuraminidase__InfluenzaA__AID70522
augaauccaaaucaaaagauaauaacgauuggcucuguuucucucaccauuuccacaauaugcuucuucaugcaaauugccaucuugauaacuacuguaacauugcauuucaggcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56050 - RNA, 1410 nt, Artificial Sequence
  neuraminidase__InfluenzaA__AID70523
augaauccaaaucaaaagauaaaaacgauuggcucuguuucucucaccaauuccacaauaugcaucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuugggguaugaaaccuucaaagucauugaaggcugguccaacccuaaguccaaauugcagauaaauaggcaauucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56051 - RNA, 1410 nt, Artificial Sequence
  neuraminidase__InfluenzaA__AID70524
augaauccaaaucaaaagauaauaacgauuggcgcuguuuggcgcaccauuucgacaauaugcuucuucaugcaaauugccuucuugauaacuacuguaacauugcauuucaagcaauaugaauucaacucccccccaaacaaccaagugaugccaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56052 - RNA, 1410 nt, Artificial Sequence
  neuraminidase__InfluenzaA__AID70525
augaauccaaaucaaaagauaauaacgauuggcucuguuucucugaccauuuggauaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaaugagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaauaucaugccuauauaa

SEQ ID NO: 56053 - RNA, 1410 nt, Artificial Sequence
  neuraminidase__InfluenzaA__AID70526
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56054 - RNA, 1410 nt, Artificial Sequence
  neuraminidase__InfluenzaA__AID70527
augaauccaaaucaaaagauaauaacgauuggcucuguuucucugaccauguggauaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacaucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56055 - RNA, 1410 nt, Artificial Sequence
  neuraminidase__InfluenzaA__AID70528
augaauccaaaucaaaagauaauaacgauuggcucuguuucucucagcauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucuaaugccuauauaa

SEQ ID NO: 56056 - RNA, 1410 nt, Artificial Sequence
  neuraminidase__InfluenzaA__AID70529
augaauccaaaucaaaagauaauaacgauuggaucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56057 - RNA, 1410 nt, Artificial Sequence
  neuraminidase__InfluenzaA__AID70530
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaauaucaugccuauauaa

SEQ ID NO: 56058 - RNA, 1410 nt, Artificial Sequence
  neuraminidase__InfluenzaA__AID70531
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56059 - RNA, 1410 nt, Artificial Sequence
  neuraminidase__InfluenzaA__AID70532
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaaugagacgucacguuuaggguaugaaacccucaaagucauugaaggcugguccaaccccaaguccaaauugcagauaaauaggcaagucauaguugacagagguaauagguccgguuauuaugguauuuucucuguugaaggcaaaagcugcaucaaucggugcuuuuauguggaguugauuuggggaagaaaagaggaaauugaagucuuguggaccucaaacaguaaaguuguguuuuguggcaccucagguacauauggaacaggcucaucgccugauggggcggaccucaauuucaugccuauauaa

SEQ ID NO: 56060 - RNA, 1410 nt, Artificial Sequence
  neuraminidase__InfluenzaA__AID70533
augaauccaaaucaaaagauaauaacgauuggcucuguuucucucgccauuucgacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaaugagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56061 - RNA, 1410 nt, Artificial Sequence
  neuraminidase__InfluenzaA__AID70534
augaauccaaaucaaaagauaauaacgauuggcucuguuucucucagcauuuacauaauaugcuucuucaugcaaauugccaucuugauaacuacuguaacauugcauuucaagcaauaugaauucaacucccccccaaacaaccaagcgaugccaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuagacuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56062 - RNA, 1410 nt, Artificial Sequence
  neuraminidase__InfluenzaA__AID70535
augaauccaaaucaaaagauaauaacgauuggcucuguuucucucgccaugugcacuauaugcuucuucaugcaaauugccaucuugauaacuacuguaacauugcauuucaagcaauaugaauucaacucccccccaaacaaccaagcgaugccaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuagacuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56063 - RNA, 1410 nt, Artificial Sequence
  neuraminidase__InfluenzaA__AID70536
augaauccaaaucaaaagauaauaacgauuggcucuguuucucucaccauuuccacaguaugcuucuucaugcaaauugccaucuugauaacuacuguaacauugcauuucaagcaauaugaauucaacucccccccaaacaaccaagugaugcuaugugaaccaacaauaauagacagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaaugagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56064 - RNA, 1410 nt, Artificial Sequence; identical to SEQ ID NO: 56053
  neuraminidase__InfluenzaA__AID70537

SEQ ID NO: 56065 - RNA, 1410 nt, Artificial Sequence
  neuraminidase__InfluenzaA__AID70538
augaauccaaaucaaaagaaaauaacgauuggcgcuguuucucucaccaugugcacagugugcaucuucaugcaaauugccaucuugauaacuacuguaacauugcauuucaggcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56066 - RNA, 1410 nt, Artificial Sequence
  neuraminidase__InfluenzaA__AID70539
augaauccaaaucaaaagauaauaacgauuggcucuguuucucucaccauuuccacgauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuugaauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56067 - RNA, 1410 nt, Artificial Sequence; identical to SEQ ID NO: 56053
  neuraminidase__InfluenzaA__AID70540

SEQ ID NO: 56068 - RNA, 1410 nt, Artificial Sequence; identical to SEQ ID NO: 56053
  neuraminidase__InfluenzaA__AID70541

SEQ ID NO: 56069 - RNA, 1410 nt, Artificial Sequence
  neuraminidase__InfluenzaA__AID70633
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaagcaugcaaucaaagcgucauuacuuaugaaaacaacacuuggguaaaucagacauauguuaacaucagcaacaccaacuuugcugccggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugaggacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggggacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56070 - RNA, 1398 nt, Artificial Sequence
  neuraminidase__InfluenzaA__AID70635
augaauccaaaacagaagauucuaugcacuucagccacugcuaucauaauaggcgcaaucgcaguacucauuggaauagcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagaaagaacaagcaggaauuucaauaacuuaacuaaagggcucuguacuauaaauucauggcacauauaugggaaagacaaugcaguaagaauuggagaaagcucggauguuuuagucacaagagaacccuauguuucaugcgacccagaugaaugcagguucuaugcucucagccaaggaacaacaaucagagggaaacacucaaacggaacaauacacgaugggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacagggauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaucuggauggggcuaacacuuggcuagggaggacaauaagcacagccucgaggucuggauacgagauguuaaaagugccaaaugcauugacagaugauagaucaaagccaauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 56071 - RNA, 1401 nt, Artificial Sequence
  neuraminidase__InfluenzaA__AIG44695
augaauccaaaccagaagauaacagcaauuggcucuguuucucuaaucauugcgauaauaugucuccucaugcagauugccaucuuaacaacgacuaugacacuacauuucaggcagaaugaaugcaguaacccaucgaauaaucaagugaugccaugugaaccaaucauaauagagaggaacacagugcauuugaauagcacuaccauagagagggaaauuuguccuaaaguagcagaauacaagaauuggucaaaaccacaaugucaaauuacaggguucgccccuuuuucaaaggacaacucaauuaggcucucugcaaguggggauaucugggugacaagagaacccuaugucucaugcagucucgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauguuuguguuacuggggaugauaaaaaugcuacugcuaguaucaucuaugaugggaugcuugucgacaguguugguucaugguccaaaaacauccucagaacucaggagucagaaugcguuugcaucaauggaacuugugcagugguaaugacugauggaagugcaucaggaaaggccgacacuagaguauuauuuauaagagaagggaaaauuauaaauauuagcccauugucaggaagugcucagcacguugaggaaugcucuuguuacccucgguauccugaaguuaggugugucugcagagacaauuggaagggcuccaauaggcccauucuauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagaccuuuagggucgucaaugguuggaccauggcuaauucaaagucacagauaaauaggcaagucauaguugacagugacggcuggucuggguauucuggcaucuucucuguugaaggcaaaaaaugcaucaacagguguuuuuauguggaguugauaagagggagaccacaggaacccagagugugguggaccucaaauagcaucauuguguucuguggaaccucugguacauauggaacaggcucauggccugauggagcgaauaucaacuucaugccuauauaa

SEQ ID NO: 56072 - RNA, 1410 nt, Artificial Sequence
  neuraminidase__InfluenzaA__AIJ10793
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaaugagacgucacguuuaggguaugaaaccuucaaagccauugaaggcugguccaacccuaaguccaaauugcagacaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccuuaaucucaugccuauauaa

SEQ ID NO: 56073 - RNA, 1410 nt, Artificial Sequence; identical to SEQ ID NO: 51386
  neuraminidase__InfluenzaA__AIJ10794

SEQ ID NO: 56074 - RNA, 1410 nt, Artificial Sequence; identical to SEQ ID NO: 55713
  neuraminidase__InfluenzaA__AIJ10795

SEQ ID NO: 56075 - RNA, 1410 nt, Artificial Sequence
  neuraminidase__InfluenzaA__AIJ10796
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggacaucaaacaguauuguuguguuuuguggcaccucagguacauauggaacaggcucauggccugauggggcggaccucaaucucaugccuauauaa

SEQ ID NO: 56076 - RNA, 1410 nt, Artificial Sequence
  neuraminidase__InfluenzaA__AIJ10797
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaagacaaaagcugcaucaaucggugcuuuuauguggaguugauuaggggaagaaaagaggaaacugaagucuuguggacaucaaacaguauuguuguguuuuguggcaccucagguacauauggaacaggcucauggccugauggggcggaccucaaucucaugccuauauaa

SEQ ID NO: 56077 - RNA, 1410 nt, Artificial Sequence
  neuraminidase__InfluenzaA__AIJ10798
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccacacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56078 - RNA, 1410 nt, Artificial Sequence
  neuraminidase__InfluenzaA__AIJ10799
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguaucguuguguuuuguggcaccucagguacauauggaacaggcucauggccugauggggcggaccucaaucucaugccuauauaa

SEQ ID NO: 56079 - RNA, 1410 nt, Artificial Sequence
  neuraminidase__InfluenzaA__AIJ10800
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56080 - RNA, 1410 nt, Artificial Sequence
  neuraminidase__InfluenzaA__AIJ10801
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacaaggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaacggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56081 - RNA, 1410 nt, Artificial Sequence; identical to SEQ ID NO: 54361
  neuraminidase__InfluenzaA__AIJ10803

SEQ ID NO: 56082 - RNA, 1410 nt, Artificial Sequence
  neuraminidase__InfluenzaA__AIJ10804
augaauccaaaucaaaagauaauaacgauuggcucuguuucucucaccauuuccacaauaugcuucuucaugcaaauugccaucuugauaacuacuguaacauugcacuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucuggaaaagcugauacuaagauacuauucauugaagaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56083 - RNA, 1410 nt, Artificial Sequence
  neuraminidase__InfluenzaA__AIJ10805
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 56084 - RNA, 1410 nt, Artificial Sequence
  neuraminidase__InfluenzaA__AIJ10806
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauauagaaauuggucaaaaccgcaauguggcauuacaggauuugcaccuuucuccaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcauuagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguauuuuguggcaccucagguacauauggaacaggcucauggccugauggggcggaccucaaucucaugccuauauaa

SEQ ID NO: 56085 - RNA, 1410 nt, Artificial Sequence
  neuraminidase__InfluenzaA__AIJ10807
augaauccaaaucaaaagauaauaacgauuggcucuguuucucucaccauuuccacaauaugcuucuucaugcaaauugccaucuugauaacuacuguaacauugcauuucaagcaauaugaauucaacuccccaccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaagcuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56086 - RNA, 1410 nt, Artificial Sequence
  neuraminidase__InfluenzaA__AIJ10808
augaauccaaaucaaaagauaauaacgauugguucuguuucucucaccauuuccacaauaugcuucuucaugcaaauugccaucuugauaacuacuguaacauugcacuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuugcauaacgggggaugauaaaaaugcaacugcuagcuucauuuacaaugggaggcuuguagauaguguuguuucaugguccaaagaaguucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaaccccaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56087 - RNA, 1410 nt, Artificial Sequence; identical to SEQ ID NO: 56082
  neuraminidase__InfluenzaA__AIJ10809

SEQ ID NO: 56088 - RNA, 1410 nt, Artificial Sequence
  neuraminidase__InfluenzaA__AIJ10810
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56089 - RNA, 1410 nt, Artificial Sequence
  neuraminidase__InfluenzaA__AIJ10812
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauggaaagaaacguaacagagauaguguaucugaccaacaccaccauagagaaggaaauaugcccuaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucgaacucuauugaugaaugaguuggguguuccuuuucaucuggggaccaagcaagugugcauagcaugguccagcucaaguugucacgauggaaaagcauggcugcauguuuguauaacaggggaugauaaaaaugcaacugcaagcuucauuuacaaugggaggcuuguagauaguguuguuucaugguccaaagaaauucucagaacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56090 - RNA, 1410 nt, Artificial Sequence
  neuraminidase__InfluenzaA__AIJ10813
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauggaaagaaacguaacagagauaguguaucugaccaacaccaccauagagaaggaaauaugcccuaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacccaguacgugauaggaccccuuaucgaacucuauugaugaaugaguuggguguuccuuuucaucuggggaccaagcaagugugcauagcaugguccagcucaaguugucacgauggaaaagcauggcugcauguuuguauaacaggggaugauaaaaaugcaacugcaagcuucauuuacaaugggaggcuuguagauaguguuguuucaugguccaaagaaauucucagaacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56091 - RNA, 1410 nt, Artificial Sequence
  neuraminidase__InfluenzaA__AIJ10814
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaguagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacaggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaaguuauugaaggcugguccaacccuaaguccaaauugcagauaaauaggcaagucauaguugacaaaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56092 - RNA, 1410 nt, Artificial Sequence
  neuraminidase__InfluenzaA__AIJ10815
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagauaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaaaugaagucuuguggaccucaaacaguauuguuguguuuuguggcaccucagguacauauggaacaggcucauggccugauggggcggaccucaaucucaugccuauauaa

SEQ ID NO: 56093 - RNA, 1410 nt, Artificial Sequence
  neuraminidase__InfluenzaA__AIJ10816
augaauccaaaucaaaagauaauaacgauuggcucuguuucucucaccaucuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaggcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56094 - RNA, 1410 nt, Artificial Sequence
  neuraminidase__InfluenzaA__AIJ10817
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuauccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaauggaaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaggucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56095 - RNA, 1410 nt, Artificial Sequence
  neuraminidase__InfluenzaA__AIJ10818
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56096 - RNA, 1410 nt, Artificial Sequence
  neuraminidase__InfluenzaA__AIJ10819
augaauccaaaucaaaagauaauaacgauuggcucuguuucucucaccauuuccacaauaugcuucuucaugcaaauugccaucuugauaacuacuguagcauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcuaauacuaaaauacuauucauugaggaggggaaaauaguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaccggugcuuuuauguggaguugauuaggggaagaaaagaggaaacugaaguuuuguggaccucaaacaguauuguuguguuuuguggcaccucagguacauauggaacaggcucauggccugauggggcggaccucaaucucaugccuauauaa

SEQ ID NO: 56097 - RNA, 1410 nt, Artificial Sequence; identical to SEQ ID NO: 56088
  neuraminidase__InfluenzaA__AIJ10820

SEQ ID NO: 56098 - RNA, 1410 nt, Artificial Sequence
  neuraminidase__InfluenzaA__AIJ10821
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaagagcugcaucaaucggugcuuuuauguggaauugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56099 - RNA, 1410 nt, Artificial Sequence
  neuraminidase__InfluenzaA__AIJ10822
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauacccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaaguuauaguugacagaggugauagguccgguuauucugguauuuucucuguugaaggcaaaagcugcaucaaucggugcuuuuauguggaguugauuaggggaagaaaagaggaaaaugaagucuuguggaccucaaacaguauuguuguguuuuguggcaccucagguacauauggaacaggcucauggccugauggggcggaccucaaucucaugccuauauaa

SEQ ID NO: 56100 - RNA, 1410 nt, Artificial Sequence
  neuraminidase__InfluenzaA__AIJ10823
augaauccaaaucaaaagauaauaacgauuggcucuguuucucucaccauuuccacaauaugcuucuucaugcaaauugccaucuugauaacuacuguaacauugcauuucaaucaauaugaauucaacucccccccaaacaaccaagugaugcugugugaaccaacaauaauagaaagaaacauaacagagauaguguaucugaccaccaccaccauagagaaggaaauaugccccaaaccagcagaauacagaaauuggucaaaaccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuuucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcuguuacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccgguuauguguguucaggacuuguuggagacacacccagaaaaaacgacagcuccagcaguagccauuguuugaauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucgguguuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56101 - RNA, 1410 nt, Artificial Sequence
  neuraminidase__InfluenzaA__AIJ10824
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaguggugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaaggacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56102 - RNA, 1410 nt, Artificial Sequence
  neuraminidase__InfluenzaA__AIJ10827
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaagaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56103 - RNA, 1410 nt, Artificial Sequence
  neuraminidase__InfluenzaA__AIJ10828
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaagugcuaucaauucgcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucagggagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaggcaaaagcugcaucaaucggugcuuuuauguggaguugauuaggggaagaaaagaggaaacugaagucguguggaccucaaacaguauuguuguguuuuguggcaccucagguacauauggaacaggcucauggccugauggggcggaccucaaucucaugccuauauaa

SEQ ID NO: 56104 - RNA, 1410 nt, Artificial Sequence
  neuraminidase__InfluenzaA__AIJ10829
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaauugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaaggugaucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugggauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56105 - RNA, 1410 nt, Artificial Sequence
  neuraminidase__InfluenzaA__AIJ10830
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacaaaaauuggucaaaaccgcaauguggcauuacaggauuugcaccuuuuucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaagaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauaggucagguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56106 - RNA, 1410 nt, Artificial Sequence
  neuraminidase__InfluenzaA__AIJ10831
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56107 - RNA, 1410 nt, Artificial Sequence
  neuraminidase__InfluenzaA__AIJ10832
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggaauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56108 - RNA, 1410 nt, Artificial Sequence
  neuraminidase__InfluenzaA__AIJ10834
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaagaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaagcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56109 - RNA, 1410 nt, Artificial Sequence
  neuraminidase__InfluenzaA__AIJ10835
augaauccaaaucaaaagauaauaacgauuggcucuguuucucucaccauuucuacaauaugcuucuucaugcaaauugccaucuugauaacuacuguaacauugcauuucaagcaauaugaauucaacuccaccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56110 - RNA, 1410 nt, Artificial Sequence
  neuraminidase__InfluenzaA__AIJ10836
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugggauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56111 - RNA, 1410 nt, Artificial Sequence
  neuraminidase__InfluenzaA__AIJ10837
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucauucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauuacagauaaauaggcaagucauaguugacagaggugauagguccgguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56112 - RNA, 1410 nt, Artificial Sequence
  neuraminidase__InfluenzaA__AIJ10838
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggagauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggacaaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56113 - RNA, 1410 nt, Artificial Sequence
  neuraminidase__InfluenzaA__AIJ10841
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggauaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggagaagcugauacuaaaauacuauucauugaggaggggaaaaucguucauacuagcacauugucaggaagugcucagcaugucgaagagugcucuugcuauccucgauauccuggugucagaugugucugcagagauaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56114 - RNA, 1410 nt, Artificial Sequence
  neuraminidase__InfluenzaA__AIJ10842
augaauccaaaucaaaagauaauaacgauuggcucuguuucucucaccauuucuacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggacaaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugacagguccgguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56115 - RNA, 1410 nt, Artificial Sequence; identical to SEQ ID NO: 56112
  neuraminidase__InfluenzaA__AIJ10843

SEQ ID NO: 56116 - RNA, 1410 nt, Artificial Sequence
  neuraminidase__InfluenzaA__AIJ10844
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuuucggacuuuguugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcuguuacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccgguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacaaucaacgagacgucacgcuuaggguaugaaaccuucaaagucauuaaaggcugguccaacccuaaguccaaauugcagauaaauaggcaagucauaguugacagaggugauagguccgguuauucugguauuuucucuguugaaggcaaaagcugcaucaaucgguguuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56117 - RNA, 1410 nt, Artificial Sequence
  neuraminidase__InfluenzaA__AIJ10845
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaucauagagaaggaaauaugccccaaaccagcagaauacagaaauuggucaaaaccgcaauguggcauuacaggauuugcaccuuuuucuaaggacaauucgaucaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuuucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcuguuacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccgguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucgguguuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56118 - RNA, 1410 nt, Artificial Sequence
  neuraminidase__InfluenzaA__AIJ10847
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuucagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56119 - RNA, 1410 nt, Artificial Sequence
  neuraminidase__InfluenzaA__AIJ10848
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggagauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggacaaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56120 - RNA, 1410 nt, Artificial Sequence
  neuraminidase__InfluenzaA__AIJ10849
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacacaaccauagagaaggaaauaugccccaaaccagcagaauacagaaauuggucaaaaccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacgguacgugauaggaccccuuuucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcuguuacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccgguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucgguguuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56121 - RNA, 1410 nt, Artificial Sequence; identical to SEQ ID NO: 56120
  neuraminidase__InfluenzaA__AIJ10851

SEQ ID NO: 56122 - RNA, 1410 nt, Artificial Sequence; identical to SEQ ID NO: 56120
  neuraminidase__InfluenzaA__AIJ10852

SEQ ID NO: 56123 - RNA, 1410 nt, Artificial Sequence; identical to SEQ ID NO: 56116
  neuraminidase__InfluenzaA__AIJ10853

SEQ ID NO: 56124 - RNA, 1410 nt, Artificial Sequence; identical to SEQ ID NO: 56116
  neuraminidase__InfluenzaA__AIJ10854

SEQ ID NO: 56125 - RNA, 1410 nt, Artificial Sequence
  neuraminidase__InfluenzaA__AIJ10855
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacacaaccauagagaaggaaauaugccccaaaccagcagaauacagaaauuggucaaaaccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacgguacgugauaggaccccuuuucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcuguuacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccgguuauguguguucaggacuuguuggagacacacccagaaaaaacgacagcuccagcaguagccauuguuuggauccuaacaaugaagaaggugaucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucgguguuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56126 - RNA, 1410 nt, Artificial Sequence
  neuraminidase__InfluenzaA__AIJ10856
augaauccaaauaaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccacaauguggcauuacaggauuugcaccuuucucuaaggacaauucgauuaggcuuuccgcugguggggacaucuggguuacaagagaaccuuaugugucaugcgauccugacaagugcuaucaauuugcccuuggacagggaacaacacuaaagaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuucagcaguggccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuauugaaggcaaaagcugcaucaaucggugcuuuuauguggaguugauuaggggaagaaaagaggaaacugaaguauuguggaccucaaacaguauuguuguguuuuguggcaccucagguacauauggaacaggcucauggccugauggggcggaccucaaucucaugccuauauaa

SEQ ID NO: 56127 - RNA, 1410 nt, Artificial Sequence
  neuraminidase__InfluenzaA__AIJ10857
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuuuucuaaggacaauucgauuaggcuuuccgcugguggggacaucuggguuacaagagaaccuuaugugucaugcgauccugacaagugcuaucaauuugcccuuggacagggaacaacacuaaacaacgugcauucaaauaacacaguacgugauaggaccccuuaucggacucuacugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggaggggaagaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauaggucagguuauucugguauuuucucuauugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56128 - RNA, 1410 nt, Artificial Sequence
  neuraminidase__InfluenzaA__AIJ29348
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacauuugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56129 - RNA, 1410 nt, Artificial Sequence
  neuraminidase__InfluenzaA__AIJ29350
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaggcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56130 - RNA, 1410 nt, Artificial Sequence
  neuraminidase__InfluenzaA__AIJ29352
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcaaaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56131 - RNA, 1410 nt, Artificial Sequence
  neuraminidase__InfluenzaA__AIJ29354
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaggaggaaacugaagucuuguggaccucaaacaguauuguuguguuuuguggcaccucagguacauauggaacaggcucauggccugauggggcggaccucaaucucaugccuauauaa

SEQ ID NO: 56132 - RNA, 1410 nt, Artificial Sequence; identical to SEQ ID NO: 53429
  neuraminidase__InfluenzaA__AIJ29356

SEQ ID NO: 56133 - RNA, 1410 nt, Artificial Sequence
  neuraminidase__InfluenzaA__AIJ29358
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaagguuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56134 - RNA, 1410 nt, Artificial Sequence
  neuraminidase__InfluenzaA__AIJ29360
augaauccaaaucaaaagauaauaacgauuggcucuguuucucucaccauuuccacaauaugcuucuucaugcaaauugccaucuugacaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggaccuuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccugguguaagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56135 - RNA, 1410 nt, Artificial Sequence
  neuraminidase__InfluenzaA__AIJ29362
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaggaggaaacugaagucuuguggaccucaaacaguauuguuguguuuuguggcaccucagguacauauggaacaggcucauggccugauggggcggaccucaaucucaugccuauauaa

SEQ ID NO: 56136 - RNA, 1410 nt, Artificial Sequence
  neuraminidase__InfluenzaA__AIL93626
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuauguaaaucagacauauguuaacaucagcaacaccaauuuugcugcuggacggucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguauugucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56137 - RNA, 1410 nt, Artificial Sequence
  neuraminidase__InfluenzaA__AIL93648
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggagaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaacuuucaaagucauugaaggcugguccaacccuaaguccaaauugcagauaaauaagcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56138 - RNA, 1410 nt, Artificial Sequence
  neuraminidase__InfluenzaA__AIL93660
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56139 - RNA, 1410 nt, Artificial Sequence; identical to SEQ ID NO: 56138
  neuraminidase__InfluenzaA__AIL93672

SEQ ID NO: 56140 - RNA, 1410 nt, Artificial Sequence
  neuraminidase__InfluenzaA__AIL93684
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaacucugcuacuggacagucagugguuuccgugaaauuagcgggcaauuccucucucuguccuguuaguggaugggcuauauacaguaaagacaacaguguaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguauugucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacaggacuggauuguauaagaccuugcuucuggauugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56141 - RNA, 1410 nt, Artificial Sequence
  neuraminidase__InfluenzaA__AIL93719
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaacuuucaaagucauugaaggcugguccaacccuaaguccaaauugcagauaaauaagcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56142 - RNA, 1410 nt, Artificial Sequence
  neuraminidase__InfluenzaA__AIL93743
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaagcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56143 - RNA, 1410 nt, Artificial Sequence; identical to SEQ ID NO: 56142
  neuraminidase__InfluenzaA__AIL93755

SEQ ID NO: 56144 - RNA, 1410 nt, Artificial Sequence
  neuraminidase__InfluenzaA__AIL93767
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56145 - RNA, 1410 nt, Artificial Sequence; identical to SEQ ID NO: 56138
  neuraminidase__InfluenzaA__AIL93779

SEQ ID NO: 56146 - RNA, 1410 nt, Artificial Sequence
  neuraminidase__InfluenzaA__AIL93791
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagaacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaagcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56147 - RNA, 1410 nt, Artificial Sequence; identical to SEQ ID NO: 56142
  neuraminidase__InfluenzaA__AIL93803

SEQ ID NO: 56148 - RNA, 1410 nt, Artificial Sequence
  neuraminidase__InfluenzaA__AIL93815
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggauccaaucggcccaucguagauauaaacauaaaggaucauagcauuguuuacaguuauguguguucaggacuuguuggagacacacccagaaaaaacgacagcuccagcaguagccauuguuugaauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56149 - RNA, 1410 nt, Artificial Sequence; identical to SEQ ID NO: 56138
  neuraminidase__InfluenzaA__AIL93827

SEQ ID NO: 56150 - RNA, 1410 nt, Artificial Sequence
  neuraminidase__InfluenzaA__AIL93839
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaacuuugcuacuggacagucagugguuuccgugaaauuagcgggcaauuccucucucugcccuguuaguggaugggcuauauacaguaaagacaacaguguaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56151 - RNA, 1410 nt, Artificial Sequence
  neuraminidase__InfluenzaA__AIL93850
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaacuuugcuacuggacagucagugguuuccgugaaauuagcgggcaauuccucucucugcccuguuaguggaugggcuauauacaguaaagacaacaguguaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugguccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaagggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56152 - RNA, 1410 nt, Artificial Sequence; identical to SEQ ID NO: 56141
  neuraminidase__InfluenzaA__AIL93861

SEQ ID NO: 56153 - RNA, 1410 nt, Artificial Sequence
  neuraminidase__InfluenzaA__AIL93885
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucgaacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguguuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56154 - RNA, 1410 nt, Artificial Sequence; identical to SEQ ID NO: 56142
  neuraminidase__InfluenzaA__AIL93897

SEQ ID NO: 56155 - RNA, 1410 nt, Artificial Sequence
  neuraminidase__InfluenzaA__AIL93909
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaccgaacccuaaugagcugcccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaauguguauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgaccuaaagagaacacaaucuggacuagcgggagcagcauauccuuuugugguguaaacagugacacuguggguuggucuuggccagacggugcugaguugccauuuaccauugacaaguaa

SEQ ID NO: 56156 - RNA, 1410 nt, Artificial Sequence; identical to SEQ ID NO: 56142
  neuraminidase__InfluenzaA__AIL93920

SEQ ID NO: 56157 - RNA, 1410 nt, Artificial Sequence
  neuraminidase__InfluenzaA__AIL93943
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccucggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuagaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggacccgaauggguggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56158 - RNA, 1410 nt, Artificial Sequence
  neuraminidase__InfluenzaA__AIL93954
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaagcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56159 - RNA, 1410 nt, Artificial Sequence; identical to SEQ ID NO: 56142
  neuraminidase__InfluenzaA__AIL93966

SEQ ID NO: 56160 - RNA, 1410 nt, Artificial Sequence
  neuraminidase__InfluenzaA__AIL93978
augaauccaaaucaaaagauaauaacgauuggcucuguuucucucaccauuuccacaauaugccucuucaugcaaauugccaucuugauaacuacuguaacauugcauuucaagcaauaugaauucaacucccccccaaacaaccaagugaugcuaugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56161 - RNA, 1410 nt, Artificial Sequence
  neuraminidase__InfluenzaA__AIL93990
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucaucacuuaugaaaacaacacuuggguaaaucagacauauguuaacaucagcaacaccaacuuugcuacuggacagucagugguuuccguuaaauuagcgggcaauuccucucucuguccuguuaguggaugggcuauauacaguaaagacaacaguguaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56162 - RNA, 1410 nt, Artificial Sequence; identical to SEQ ID NO: 56138
  neuraminidase__InfluenzaA__AIL94001

SEQ ID NO: 56163 - RNA, 1410 nt, Artificial Sequence; identical to SEQ ID NO: 56141
  neuraminidase__InfluenzaA__AIL94013

SEQ ID NO: 56164 - RNA, 1410 nt, Artificial Sequence; identical to SEQ ID NO: 56141
  neuraminidase__InfluenzaA__AIL94025

SEQ ID NO: 56165 - RNA, 1410 nt, Artificial Sequence; identical to SEQ ID NO: 56142
  neuraminidase__InfluenzaA__AIL94037

SEQ ID NO: 56166 - RNA, 1410 nt, Artificial Sequence; identical to SEQ ID NO: 56142
  neuraminidase__InfluenzaA__AIL94049

SEQ ID NO: 56167 - RNA, 1410 nt, Artificial Sequence; identical to SEQ ID NO: 56150
  neuraminidase__InfluenzaA__AIL94061

SEQ ID NO: 56168 - RNA, 1410 nt, Artificial Sequence
  neuraminidase__InfluenzaA__AIL94072
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaacuuugcuacuggacagucagugguuuccgugaaauuagcgggcaauuccucucucuguccuguuaguggaugggcuauauacaguaaagacaacaguguaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguauugucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacaggacuggauuguauaagaccuugcuucuggauugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56169 - RNA, 1410 nt, Artificial Sequence
  neuraminidase__InfluenzaA__AIL94083
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaacuuugcuacuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56170 - RNA, 1410 nt, Artificial Sequence; identical to SEQ ID NO: 56141
  neuraminidase__InfluenzaA__AIL94238

SEQ ID NO: 56171 - RNA, 1410 nt, Artificial Sequence
  neuraminidase__InfluenzaA__AIL94250
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaauuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaaaugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauauauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56172 - RNA, 1410 nt, Artificial Sequence; identical to SEQ ID NO: 56138
  neuraminidase__InfluenzaA__AIL94261

SEQ ID NO: 56173 - RNA, 1410 nt, Artificial Sequence; identical to SEQ ID NO: 56138
  neuraminidase__InfluenzaA__AIL94273

SEQ ID NO: 56174 - RNA, 1410 nt, Artificial Sequence; identical to SEQ ID NO: 56138
  neuraminidase__InfluenzaA__AIL94285

SEQ ID NO: 56175 - RNA, 1410 nt, Artificial Sequence
  neuraminidase__InfluenzaA__AIL94297
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagaacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaagcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56176 - RNA, 1410 nt, Artificial Sequence
  neuraminidase__InfluenzaA__AIL94309
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaagcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuugugggaccucagguacauauggaacaggcucauggccugauggggcggaccucaaucucaugccuauauaa

SEQ ID NO: 56177 - RNA, 1410 nt, Artificial Sequence; identical to SEQ ID NO: 56160
  neuraminidase__InfluenzaA__AIL94321

SEQ ID NO: 56178 - RNA, 1410 nt, Artificial Sequence
  neuraminidase__InfluenzaA__AIL94368
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcacuucagguacauauggaacaggcucauggccugauggggcggaccucaaucucaugccuauauaa

SEQ ID NO: 56179 - RNA, 1410 nt, Artificial Sequence
  neuraminidase__InfluenzaA__AIL94380
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccgucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaagcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa
